United States Patent 9,976,180 (METHODS FOR DETECTING A GENETIC VARIATION IN SUBJECTS WITH PARKINSONISM) - sequence listing, part 5

SEQ ID NO: 72 - DNA, 18527786 bp, Homo sapiens (residues 2,058,644-4,117,286 of 18,527,786)
  misc_feature (4041202)..(4061201): n is a, c, g, or t
aaaaataataataataaaataaacttccctagtgaccagaattacattgcctaaccttgactaaactaaatgttgatgggtcaaagtgtattaaaaaagaaacgtggctgggtgcagtggctcacgcctgtaatcccagcattttgggaggccaaggctggtggattacctgaggtcaggcgttcgagaccagcctagccaacatggcgataccctgtctctactaaaaatacaaaaattagccgggcatggtggcgcgtgcctgtaatcccagctacttgggggctgaggcaggaggatcacttgaacttgggaggcagaggttgcagtgagccgagattgtgccagtgcactccagcctgggcaacagagcaagactccatctcacaaaaaaaaaaaaaaagaaagaaacgcttcttatggacaaagcagttggaggttggcttgtgggtaggctatccagggctggtatggcagcttcatggtatcatcaaaaacccataagcttaggccaggcatggtggctcacacctgtaatcaagcagtttaggatgcggaggccagaggatcacctgagcccaggagttcaggaccagcctgggcaatgtggtgaaaccctgtttctacaaaaaatcccaaaacattagccaggggccaggcacagtggctcacacctgtaatcccagcactttgagagaccacagccagaggatcatttgaggtcgggctttcaagaccagcctggccaacaaggtgaagccccatctctactaaaaatataaaaattggctgggcattgcattgccaagataatcctaagcaaaaagaacaacgctggaggcatcacgttacctgacttcaaactataccacaaggctacagtaaccaaaagagcatggtactgctaccaaaacagatgtatagaccaatgaaacagtacagaggcctcagaaataacaccacacacctacaaccatctgatctttgacaaacctgacaaaaacaagaaatggggaaaggattccctatttaataaatggtgctggaaaaactggctagccatatgtagaaagctgaaatggatcccttccttacaccttatacaaaaattaattcaagatggattaaagacttacatgttagacctaaaaccataagaaccctagaagaaaacctaggcaataccactcaggacataggcatgggcaaagacttcatgactaaaacaccaaaagcaatggcaacaaaagccaaaatagacaaataggatctaattaaactaaagagcttctgcatggcaaaagaaactaccatcagagtgaacaggcaacctacagaatgggagaaaatttttgcaatctacccatctgacaaagggctaatatccagaatctacaaagaactcaaacaaatttaccagaaaaaaacaaccccatcaaaaagtgggcaaaggatatgaacagacacttctcaaaagaagacatctgtgcagccaacagacacatgaaaaaatgctcatcactggtcatcagagaaatgcaaatcaaaaccacaatgagataccatctcacgccagttagaatagcaatcattaaaaagtcaggaaacagcagatgctggagaggatgtggagaaataggaatgcttttacactgttggtgggagtgtaaattagttcaaccattgtggaagacagtgtggtgattcctcaaggatctaggactagaattaccatttgacccagcaatcccattactgggtatatacccaaagggttataaatcatgctactataaagacacatgcacacacatgtttattgtggcactattcacaatagcaaagacttggaaccaacccaaatgtccatcaatgatagactcgattaagaaaatgtggcacatatataccatggaatactatgcagccataaaaaacgatgcgttcatgtcctttgcagggacatggatgaagctggaaaccatcatcctcagcaaactatcacaaggacagaagaacaaacaccacatgttctcactcataggtgggaattgaacaaaaagaacacttggacacagggtggggaacatcacacactggggcctgtcagggggtggcggcctgggggagggatagcattaggagaaatacctaatgtaaatgatgagttgatgggtgcagcaaaccaacatagcacatgtatacctatgtatcaaacctgcaggttgtgtgcatgtaccctagaacttaaagtataattttaaaaaaattggctgggcgtggtggcatgtgcctgtggtcctagctactcaggaggctgagatgggagaatcgcttgaacctgggaggcagaggctgcagtaagctgagatcataccactgcactccagcctgggtgacacagcaagattccgtctcaaaaaaaaaaatttattatttttttaaaatagtaaaatcactaaacttgtgcaatggtagcatggaaattatctgaggtgtactgtatgattgtattttaaccagggtggacatagcttaaattataaaaactaaagatgaaagtacaaggaagcacaagtataaattatacaagtataaattcatgctgcctacttctaagagaactttcattcttcataaccacataacattataatgccactgactcataaggggtttacattaattctatgggggagaacactagaattattagtgttcattttcatctaagatcttttttctctaacattcttggtcctattgaaacattgcagtatgcagaaatactgtaatgttaaacccaagagaaaagccattatcatgtgtacgctggtcatcatgatcagtgtggtacaatttaaaaaaataaactatcatgcccttcatgaaaaaaaaaaattacctgggcatgggggcacatgcctgtagtcccagccacttgggaggctgaggtgggaggatcacctgagacccaggaagtcgaggctacagtgagtgatgatggcgccaccgcactccggcccaggagctgctcatgttattttactggcttaacagtgttacggccaatgtctctgtgattctcttggccttttcctcatgattgtggcctcaaggaatgtattcttccatgagcaacgtgtgatcagcctctccgagtgaggtgccaagagtgttcccgtttaatatctcacaattaaatcagaactatttactgggcatcatttattaagcactgtttattaagcactttctgaatgccaggcaccttaaaaacattccctctaattctcacaattccctacaaagttgagattattatccttatttaaaagacaagaaggtgagaatctggaggttgaaatttttaatttaaaaaaagagagagagagggccaggcacaatggctcaggcctgtaatcccagcaaactttggaaggctgaggagggaggatagcttgagcccaggagttcaagactagtttcatagggagaccccatctcttaaaaaaatttaaaaattagaagggcgtggtggccacacacctgtggtctcagctacttgggacatttgagcttgggagttcaggactgcagtgatcgatgatcctaccactgtactatactccagcctgggtgacagataaaaaccctgtctcaaaaaaaaaaaaaaaagaaaaatgcttatgagcacagactgtgatggaaaggtggaaatgcgacacgtgaagcacagaggatggaggatggaggctggtaccacataggcccttggttgtattttcttttctttcttttttttttttttgttgttgttgttgttgagacggagtctctctctgtcacccaggctggagtgcagtggcgtgatctctgctcactgcaacctccgcctcctgtgccagaaggtgaaagataaaaagattgttatttataacaatcccttttcaaacacacttgagtttacgttaatgaaaggatttggggaaagttccaagataaccacaggatgacgggggctggcttccagaggatccaaccatttggtcagagggttggaagtttcagccccacccccaacctccagggaggggctcaaagtgaagttaatcaccaaaggccaattatttatcaatcatgcctacataatgatgctttttttttttttttttttttttttgagacggagtcttgctctgttgcccaggcaggagagccgtggcacgatctcggctcaccacaacctccacctcctgggttcaagagactctcctgcctcagcctcccgggtagctgggactacaggcgcacgccatcatgcccagctaatttttgcatttttagtagagacagggtttcactatgttggccaggctggtctcgaactcctgacctcgtgatccacccgcctcagcctcccaaagtgctgggattacaagcgtgagccaccacgtccggcctccttaagtgtattttcataatatacatactaaggaataccgtgcagctgttataaagaactagtaacttggctgggcaaggtgtctcacacctacaatcctagtactttgggaggctgaggtgggtggatcacctgaggtcaagagttcaggagcagcctggccaacatggtgaaactccgtctctactaaaaatacaaaaattagccgggcttggtggcatgcgcctgtaatcccaactacttgaaaggctgaggcaggagaatcgcttgaacccagagggcagaggttgcagtgagccgagattgcgccacttcactccagcctgggcgaaagagtgaaactccgtctaaaaaaaaaacaactagtaactctatatgtatctacatagaaaagaaacctcagccaggcacagtggctcacatatgtaatcccagccctttgaggggtggaagtagaagggtcacttgaggccaggagtttgggaccagtctgctaaaacataacaagaccctgtctctattttaaaaagaaagaaaaaagagagaagccaggcatggtggctcatgcctgtaatcctaatactttgggaggccaaggtgggcggattgcctgagctcaagagttcaagaccagcttgggcaacatggtgaaattccatctctacaaaaaaaataccaaacaaaaaaattagctgggtgtgatggcactcaccgtagtagtccccactactgggtagctaaggcaggaggatcacctgaccccaggagctctaggctgcagtgagccaagatcatgccactgcactccagcgtgggtgacagagtgtgaccccgtctcttaaaataaagaaattaattaatttaattaaataagaaaaaggagagagaaagagagaaaataaatctcttagtcacggggttaagtagaaaaagccagttgcagaacaacatggcccccatgtagagcaaaattatgtatttctacatgtttatgccacaaatgcataaaaataagatttggaagtgatcacggcaggaggcagacaaacgcctaggcagacggggcaggtccctggcgaaactccacctccaagacaaagacagcttgaagcctgaaagccaagctacaagtcaaatccacgaatgagactgagaacctgtcttcctatttggtgcgctttcctctgattggtccccacccttcacctagtttacatttacctaccctttcctaattggttttttacactgtccatgcccacctttgagtgatgtctttgctttaaccttttttgcatactcacaatcagcatgtagtccccattctgaggccataaaaagccccagacccagccacaaggagagagaaaccacccccacccccacatcccctctccgctgtgagctgttccgtcactccgtaaaattatctgccctcatcacccttcagtcctccacgtgacctcattcttcttgaacactggacaagagctcgggacccaccaagtgcgggtaccctgaaaggctgtcacactggccctctgcccttctaggacggcagctaccccacgtgacagggccaggggccgactgagctgctaacacaccgaccatccagggggctgtggacagtggaactaaaagagctaattagcacactaataccctctctggggcttcagggtcgcaggcatccttgcctggatgccgccatgtcccccttgaggcaatacacctggtgtgtccacgggcccgcatggagcttgctcctgtgtcagtgcttggagtggctggccagatcccgcactcactcacgtgctccctcctgtaagggggtgagtgcggcaggccaagtagacagggcgcccctgccgtgagtccaaaaaaagaaaaggctgagaaatatcctgcatcagaaggatataaaccacatttatgacctgttatctctggggcaaggattggcagaaaggggctgagtgtggtggttcacacctgtaatcctagcactctgggagactgaggcaggaggattgcttgaacccaggagtttgagacccccctgggcaacatagtgaaacctcgtctctgcaaaaaaaataaacaaaattagccaggtgtggcacacacctgtagtcccagctacttgggaggcttgggaggctgagatgggaggattgcttgagccctggttaagttgaggcttcagtgagctgagattgtgctactgtactccagcatgggtgacagagcaagacccagtctaaaaaaaaaaaaaaaaaaatagaattggcagaaaagccaaaagagaaatgttgctttttttcccctggactctggtcactaactacctatgtgatcttgagcagactgtagcacttctgtgcctcaggctccccatctgtaaaatagggacacattcgtagttacttgataaatggttgtaaggattaagtgagttaacatacataaaacatgataaaacatgaatagtagtgcctgctacaatgttggaattaaatttgttttcattcttctgtgacttttcatggtactaatggtactaaataatctctgtcttgctgggcatggtggctcacacctgtaatcccagcactttgggaggccgaggtgggtggatcacctgaggtcaggagttcaagaccagcctgaccaacatggagaaaccccgtctctactaacaatacaaaattagccgaggtggtggcacatgcctgtaatcctagctactcaggaggctgaggcaggagaatcgcttgaacccaggaggcagaggtttcagtgagccgagatcgcaccattgcactccagcctgggcaaaaagagtgaaactctatctcaaaaataataataataataataatctctgtcttgatcagaagttggggagagtctcccctcaccattccttcagggtcttatgcggaggaaaagctgttaaaaaaaaagtgtaaaggtcaaaagtaataaggaaatcatgccctctgcagggaagcagccaccatacccagcccacacggaacgtggctgtggctgagcagtgcccccagctcctgggtgggcctctcctcccttctaagagtttctgtaaaaagatttttgagttaaaaaaaaaagtgcaaaggattatattggagacagagggttaagacaatgacgctaggataaagacaagcctgtgggtggtggaaaagactgggttgtggggttgaggggggtccaagatccagtaggcctagaatccaagaacagaagctaattatcctagttcatcaaatttaagatccatcattgtaatatacaccactattttatgttctttttttttgagacagagtcttgctctgttgccaggctggagtgcagtggtggcgcgatctcggctcactgcaacctctgcctcccgagctcaagtgattctcctgcctcagcctcccgagtagagtagctgggactacaggcatgcgctaccatgcccagctaatttttgtatttttagtagagacggggtttcaccatgttggccaggcaggtctcaaactcctgacctcgtgatctgcccacctcggcctcccaaagtgctggtggcacaggcatgagccaccacccccggcctatgtactttttaaatgctgcaattagcttattatgtcattaactgttacatgcattccaatttcaaagatattaaaaggtaaacaaatgtgcatcatagaatcattaaaatatgagtccctaagcactgaaattggaaacaatgcccttgccccaattttttaaaatgtccctgaactgtaaaataaataaacataaggggatttccccaagatgattacttttaagttttatgagggaaaatggtaaatgtcaaattctgtccctaaaccatatctcatctcttttgttcctctgtaagggctgaatcagcctgttgggtgacccaggcctgccctgggggagggaggaaatccacacaactgagtcctttgagcctctcccctgccctgagttcagtagcagctggaaaggggcccagctttatgggggaacaatggtgccagccagcttcgggtgaaacaaggctgaacagcctggctgggtctggcctgggtccagaagagtgccccttgcacctgaggggtccgctccccttcagcaaaggacagatgaagccagggaaagtggagaaagaactccctgggctttctccgtgaacagctctctacgtagaatcccagaatcacccagccagaggacctcagtgtccatggaatcaaactgctccattgtacagatgggaaaacaaaggccccaaagggggctggagcttgcctaaggtccttcagtaagtcagtggcaaagctggagccacagtcaggttccctttaattcagcatgtctaccattaagtgcaagtctgtgcgatcttttgctgttttttgttgtttgtttgtttctgtcttttaaaaatgcccaaattggctgggcgcagtggctcacgcctataatcccagcactttgggaggccaaggtgggtggatcatttgaggtcaggagtttgagaccaggctggccaacatagtgaaaccctgtctctactaaaaatacaaaaattagccagcgtggtggtacatgcctataatcccagctactcgggaggctgaggcaggagaatcgcttgaacctgggaggcagaggttgcagtgagctaagatcacgccactgcgctccagcctgcgtgacagagagagactcctactcaaaaaaaaaaaagaaagaaaatgtcaaattatgttgcttgtacaaaatgtctgtctgacacatcagatagtgtctgactcacctgcccattggaatgagaagctcaggatctcaagcatgaatgcctccaggatagaggagacctgtgggtacatgcctgcccctactccttcaaactaatatttactgtgacatagtaacttcctggcttcaaagctcacctctaacgcttcccatgtatgtgaccttgggcaaattacttatcatcgtggtagtggcctccaagatggccctcaatgattctctcttcctacataaccaccaggctactgcagaaacaggtgtgacttctgaggccaggtcagaaaagacaatgcaaggctgggcacagtgtctcatgcctgtaatcctagcactttgggaggctaaggtgggaggatcactggagtccaggagattgagatcagcccaggcaacatagccataaaacgagacctcacctctactaaaaagagaaaagaaaattagcacctgtggtctcaacctacttgggaggctgaggtgagagaatcgcctgagcccaggaagtcaaggttgcagtgagctgagatgacaccactgcattccagcctgggcaatagagcaagaacctgtctcaaaaaataaaaacagccaggcgcagtggctcatgcctgcaatcccagcactttgggaggccaaggcaggcagatcacgaggtcaggagttcgagaccaccctgaccaacatggtgaaaccccgtctctattaaaaatacaaaaattaaccgggggtggtggcacgtgcctgtaaccccagctactcaggaggctgaggcaggagaattgcttgaacttgggaggcagagattgtagtgagccaagatcgcaccattgcactccagcctgggcaacagagcgagactccgtctcaaaaacaaaaccaaacaaaaaaacaaagagactgcagcttccatcttgctctcttggatcacttgccctaagggaacttagctgctatgttataagcacactcaatgttatatgctatgttataagcacagcccaatgcagggacacacacagcaagaagtaactgagactgcttgccaacagccaactgctttgccagccgtgtgcacgggcccgcttgaaactgtatcctccaaccccagtccagcttccagatgactgcagccctggtcaacatcttgaaacttatgagatgtttctggtgagaatcactcaactaatcagctcctgaattccttgcctatagaaaatacctgaggtaataaatgtttattgctgttttaagctttgtagttttggggtaattcctgacacagccacagacaatgaatacaatcacactttgcctccttttccttaaaatgaggatgatgggaggacttgctttatataatcatgaggattccatatgatacatgaaaagaatctggctaagctgggtgcagtggctcacgcctgtaatcccaacactttggtagcccaaggtaggtggatcgcttcagcccaggagtttgagaccagcctgggcaacacagtgaaaccccgtctctacaaaaaatacaaaaattagctgggcatggtgatgtgcgcctatagtcccagctactcgggaggctgaggtgggaggatcgcttgagcctgggaagttgaggctacagtgagctgtgattgtaccactgcactccagcctaggccacagaacaagaccctgtctcaaaaaataaataaaccaataaataaaaataagaagagtctggctcatagcaaatgcacagcagataggaaccaatattgctgtattattatatggtctccactaatcaagaggagaggttgagagctatatgaggaagggccaaaaggaaagatgaagtagcaacccccagtctcttcattttcctggcaattcagctctgactacattttcatagaacctcctaagacagaagccccatggggaaacttgatctccctagaaggcagtgtagggactatttatcactctgcaagcattccccttcgggtgctcagtcttcatcatccccaccactagaacttatcaactaatttcttgcttatctactaggagtccccagtcaacagaattgactccatctcagcactttccagggacattcccaacctctggaagctatccaacaaaggcttcctttgctccttaatttatctctgagaagcaggtttaaattttagctctgctgggttgggcacagtggctcacacctgtaatcccagtgctttggggaggatgaggcaggcagatcacttgaggtcaggagttcaagaccagcctggccaacatggggaaaccccgtctctaccaaaaattagctggtcctgtgatacactagcctgtagtcccagttactcaggaggctgaggttagaggatcacgtgaccccgggaggtggagattgcagtgagctgtgatggcgccgctgttccctagcatgggtaacagagtgagaccctatctcaaaaaaaaagacctaaacaaaaattttagctctgctaccgatttgtcctttgtcaagttactcaaccccttgagcctcatctcctcgtctgccaagcagaaatagcgaatatttgcttccgggttgttgggggaagaaaatgaagcaagacagcaaggtatgaatgctttattggatggaaataataaattgtcaatgcctccggactctcaggtgctgctcaacgccctgccctgccccaggaagcttctccccacagcggaagccacttagctctcacatgcaggctctgccctgtgctgggcttgacaccaactttggtggtttttgtttttgttttcaagatggagactcgctctgttgcacaggctgaagtgcagtggtgtgatcttggctcactgcaaccgccacctcccgggttcaagcaattcttctgcctcagcctcctgagtagctgggattacaggcgcccgccaccatgcctggctaatttttgtatttttagtagagacagggttttaccattttggccaagctggtcttgaactcctgacctcaagtgatccacccacctcagcctcccaaactgctgagattacaggcatgaaccaccaggccaggcctctgttttttttgtttgtttgtttgttttggtttttttttttgagacaaagtctccctctatcacccaggctgtatgtagtgcagtggcacgatcacagctcactgtaacctccacctcccaggttcaagcgattctcgtgcctcagcatactgagtagctgggaatacaggcttgcgccaccgcatcctgctaatttttgtattttttgtagagacggggttttgccacgttggccaggctggtctcgaacttctgatctcaggtgatccacccgccttgacctcccaaagtgctgggattacaggcatgagccaccactcctggcagctttgttttttaatcagggaactttttttttttttttttttgagacagagttttgctcttgttgcccaggctggagtgcaatggtgggatcttagctcaccgcagcctccgcctcccaggttcaagcaattctcctgcctcagcctccggagtagctgggattacaggcatgtgccaccatgcccggctaattttgtatttttagtagagatggggtttctccatgttggtcagactagtctcgaactcccgacttcaggtgatccgcccgccttggcctcccaaagtgctgggattacaggcgtgagccacagcacctggcttaatcagggaactttaaccagattttatctctttcatcaggggttcagcagtaactagcatatgtgcctgactgaatgcctccttcttatgaccaaggccagcttaagataaattatttttattcctatttatttatttattatttattattattactttttgagatagaatctcactctgtcgcccaggctggagtgcaatggcgcgatctcggctcactgcaacctccgcctccagagttcgcgccattctcctgcctcagcctccagagtagctgagactacaggcgcccgccaccacgcccggctaatttttagtagagacggggtttcaccgtgttagccaggctggtctcgatctcctgacctcatgatctgcccacctcagcctcccaaagtgctgggattacaggcgtgagccaccgcgcccggcctatttatttatttttgagaagtggtcttactctgtcacctaggctggagtgcagtagcgtgatcatggctcactgcaacctcgacctcctgggcttgagtgatccacaccactgcactccaccctgggctacagagcgagactccgtttcaaagaaaaaaaaaaaaggaagaaagaactcagggttggcagaacaagctgtagtgtctctgccttgcatcctggcatctcctctggcctgactccccagggtgattttaggagttgttcctacctatgcatagctcccaatactatggctttgcccctcatggagattctgtgagccacccaacatcctgtaataactctttcctgtttaaactgaagtgagttggtttgttttgtttgcaactaagaatcttgattgacacactgcataacaactctatcagtatgtgtaccatttgtattattttgaaataattttttatttaattagttttttaaagtaatgacagtcacttgtgaagccaccatcccaaaataaaatgtagaaccttaacaataacctacatctgactatatacctccctccccacccaacctctttcccaaccctagtaaccatcctcctgaaccttatgctcatcattccctgttgcacattatttttaattttctgttgaaatataatatacatataataaactgagcaaatattaagtgtacaattcaaataatttatgtgtgtgtatagatttttgtgtaaccaaatcaacatataaacatttcccgccaggtgcagtggctcactcctgtaacgccaacactttgggaggccgaggcgggcagatcacctgaggtcgggagattgagactatcctggctaacccagtgaaatcctgtctcttttaaaaatacaaaaaattagccaggcgtgttggtacatgcctgtaatcccagctactcagaaggctgaggcaggagaattgcttgaatccgggaggcggaggttgcagtgagctgagatcgcgccattgcactccagcctgggcaacaagagcaaaactccatctcaaaaagcaaacaaacaaagaaacatttcccatcccctagaagcctctcttgtgatctctcccagccaattcctgacacttgagagttaccagtattcttacctctgtcaccctaggtttgttttgcctgttcttttgttctttttttttttttttttgagatggagtctcactctgtcacccaggttggagtgcaatgtacaatctcgcctcgctgcaacctctgcctcctgggttcaagtgattcggtgattctcctgcttcatcctcccaagtagctgggattacaggcttgtgccactacgcccagctaattttgtattcttagtagagatgacgttttgccatgttggtcaggctggtcttgaactcctgacctcaggtgatccgcccacctctgcctcccaaagtgttgggattacaggtgtgagccaccgcacctggcctgttttgcctgttcttaaaacatttaaacaaagtaggcctggcacagtggctcatgcctgtgatcccagcaacgtagggtatattttagtacaaggcggaaggatcacttgagctcaggagttcaacaccagcctgggcaacacagcaagaccttgtctctacaaaaactttttaaaaaattagccagatgtggtggctcacgcctgtagtcccagctacttggggtgggctgatgtgggaggatcacttaaagccaagagtgcaagggtgcagtgagctatgatcacacactgcactccagcttgggtgacaaagagagatcctgtttcaaaataaataaataaataaaatagtaaagtatattttttatggtatgcatttttttggtctggcttctttcactatcattatgtttctgtaattctcctgtttttgcaagtagcaatagttgttcttgtttttttttctttctttttttttctttttttgagatggagtatcgctcttcttgcccaggctggagtgcaatgaatggcacgatctcggcccactgcaacctccgcctcctgggttcaagtgatactcctgccttagcctgccgtgtacctgggattacaggcgtgcaccaccacgcccggctaattttttttttgtatttttagtagagatggggtttcatcatgttggccaggctggtctccaactcctgacctcaggtgatctgccccccttagcctcccaaagtgctgtgattacaggtgtaagtcaccaggcctggcctcatatttttctttaaattgactcacttcatttattttatttaatttatttattcattttattttattttatttttgagacggagtctccctctgtcacccaggctggagtgcagtggtacaatcttggctcactgcaacctctgcctccctggttcaagtgattctcctgcctcagcctcctgagtaactggaattacaggtgcccactgccacgctcagctaatttttgtatttttagtagagatggggtttcaccatgttggccaggctgctctcgaagttctgacctctggtgatctgcccaccttggcctcccaaagctctgggattacaggtgtgagccacctggcctttttttgtgtttgtttttttttggggggggacatggtttcactctgtggctggaagtgcagtggcatgatgatggctcactgcagcctccacgtcctaggttcaagcaatcctcctacctcagcacccccacccctgagtagctgggactacatgtgcgagctaccatgcatagctaatttgtttttattttttgtagagacagggtctcactatgttgcccaggctggtttcaaactcctggcctcaaggaattctcctgcctcagcctcccaaagtgctgggataacaggcatgagccaccttgccaggctatttattttcttttttctttttgagatggagtgtcactctgttgcccacgctggagtgcagtgccgcaatctcggctcactgcaagctccgcctcccgggttcacgccattctcctgcctcagcttccccagtagctgggactataggcgcctgccaccatgcctggctaattttttttttttttggtttttgtatttttagtagagacagggtttcaccgtgttagccaggatggtctcgacctcctgacctcgtgatctgcccgcctcggcctcccaaagtgctgggattacaggtgtgagccactgcgcccggcctattttctaaataaaatagtttgaatactaatcatattcgtacatatgcctcattctttttttttttcccccgagacggggtcttgctttcttgcctacgctggagtgcattggctccatcttgtctcactgcaacctccgcctcccaggttcaagcaattctcatgcctcagcctctcaagtaggtgggattacaggtgcccaccaccatgcccagctaatttttgtatttttagtgaagacggggtttcaccatgctggccagactggtctgaaactcctgacctcgtgatccgtctgcctcagcctcccaaagtgctaggattacaggtgtgagccactgtgctcggccttttaaattttttcttcagatggtatctggccatgttgcccaggctggatttgaactcctgggctgaaactctcctcccgctgatagatgcaggaggcagataaggggaaggcctgcctgtacactggaagaacagggtggagccacaggaagttcgagctggatgcccggagagtagcctagcctctccagttcctgtgtggtggcctggtaatcaatttgctaggtaggggcccgttagcaggatcgcctctcgcctctcactttgctgagagtttttttcttttttccttttcacccagtgaattccattctcctcacccttcaatgtctccactttcctaattcttcctggttgtgtgacaaggacctggttttagctgaactaaggagcaaagttctcaacacctttgcctcctgagtagctgggattgcaggcttatgtcactatacctgccaccttcttcttctttttttttttttagttcctgcatagtttttctagtaccataatttatctagtcctctactgttgaacattgaccttatttccaatgtttacctattacaaacattgttatgacaaataaccatgttcatcagttattttgttcattgcacatttatctaagagataaatttttagagatgaaatggctaggaaccactggctggtttttcttttcttttcttttcttttctttttttttttttggcggggagggcagacaatcaacgttcccaggttgaagcctttttttttttttttcttagacagggtgtcgctctgtcacccaggctggagtgcagtggcaggatcatggctcactgcagccttaacctcctgggctcaaccaatgctcccatttcaacctccagagtagctgggacggcaggcacataccagcacacccagttaatttttgtgtattttatagagactggggtctccctatgttgcccaaactggtcttgaattcctgggctcaagcgatcctccctccttagcctcccaaggtgctgggattacagatgtgagtcacggcgtttggccgaggccttatatttgaagacatctttattttattttatgtattttattttatttttgagatggaatcttgctgtcgccgggctggagtgcagtggcgcaatctctgctcactgcaagctctgacttcctggttcaagcgattctcctgcctcagcctcccgggtagctgggattacacgcacgcaccacgcccagctaatttttttgtatttttagcagagacggggtttcaccatgttggccagcatggtcttgaactcctgaactcatgatccgcccccgccttagcctcccaaagtgctgggattacaggcgtgagccactgcgcccagccttgaagacatctttatagaggtataattgccataccataaaatgcacacacttttagtgtataattgaatgatttatagtaaatttattgagttgtacaaccaccatgaccagaaaaaacaaactcagtttctcccactatactcacaacaggcctctgacacaagatgtataggggttttccccacacatcaggcaatcagtcagttctgcagtggacaccagctgggtgttttctagtccaaataaactctgatactatccacctgaaaataacaccaggtcccataggttgagtgctcagtccccaagactatcctcacttcagatgccagtaataagtccaggcctccagaacttcaaactaaccagccataaatcaggattcccacaactccctccctgggttccattaatttggtagagggacttacagaactcagggaaacatatacattacaaacgctacaaataaacagccagatggagagaacaaagggtaaagtctgaaagggtctggagcacgggagcttttatccctatggagatggggtgtcacctcctcctcctgcgtgtggatgtgctctcattcaccttcctggaagcctacaggtgttcagctatttagaagctctctgaacccagtcgctttggtttataatggaagcgtcaggctgggcccagaggctcacacctgtaatcccagcactttgggaggcctaggcaggtagaccacctaaggtcgggaattcgagaccagcctggccaacacggtgaaaccccatctatattaaaaatacaaaaattagctggttgtggtggcaggtgcctgtagtcccaactacttgggagattgaggcacaagaattgcttgaaccttggaggtggagattgcagtgagctgagatcacgccattgcactccagcctgggaaacagagtgagactcttgtctcaaaaaaaaaagcatcattaggtaagcatgattgataaataattggccattggtgattaacttcacttagagaccctccctggaggttgggggtggggctgaaagtttcaaccctttgaactaatggttggatcctctggcagccactctcccatcctgtggttatcttggaactttccccgaatcctgtcattaacataaattctgccgggcgctgtgtctcacacctgtaatctcagcactttgggagaccaaggcgggcggatcatgaggtgaggagattgagaccatcctggccaacatggtgcaaccccgtctctactaaaaaaaaaaaaaaaaaaaaaaaaacaaaaaactagccaggtgtggtggcacgtgcctgtaatcccagctactcaggaggctgaggcacaagaatctctttaaccagggaggcagaggttgcagtgagtggagatcgcaccactgcattccagcctggtgacagagcgagactccctctcaaaacaaaacaaaatataaactcaagtgtgtttgaaaagggattgttttaaataacaatatttttatctttcaccttctggcactgaagctattccaagaggggtttcaaagatctaggacaaaaggccaaatattttaacaaaagattttttttttttgagacagagtctcgctctattgcccaggctggagtgcagtgatgcaatctcggctcactgcaacctccgcttcctaggtttaagcaattctcctgcctcagcctcctgagtagctgggactgcaggcatatgccaccgcacccggctaattttttgtgtttttagtagagacggggtttcaccacattggccaggctggtctcgatctcctgatgtcatgatccgcctgcctcggcctaccaaagtgctgggattacaggcatgagccactgcgcccagccaacaaaatatattcttattgctttagatacttcccttatcccccaagttggattaaatgctagctctagggctgggctcagtggctcacgcctgtattcccagcactttgggaggccaaggcaggtagatcacttgaagtcaggagttggaaaccagcctggtcaacatggtaaaacctacctctactaaaaatacaaaagttgctgggctcagtggctcacgcctgcaatcccagcactttgggaggccgaagtgggctgatcacgaggtcaggaatttgagaccagcctggccagcatggtgaaaccctatctttactaaaaatacaaaaattagccaggcatggtggcgtgtgcctgtaatcccaggtacttgggaggctgaggcaggaggatcgcttgaatccaggaggcagagattgcagtgagccgatatggcgccactgcactccagcctggccaaaagtgtgactttgtctcaaaaaaaaaaaaaaagtggccgagcgcagtggctcacgcctgtaatcccagcacttgggaggccgaggtgggcagatcatgaggtcaggagttcgagaccagcctggccaacacagtgaaaccccatctctactaaaaatacaaaaattagctgggcatggtggcaggcacctgtaatctcagctactagggaggctgaggcaggagaatcgcttgaacccaggaggcggaggttgcagtagctgagatcgcatcactgcattccagcctgggtgacagagctggactgtctccaaaaaaaaagtgctgttccatttggaagtcaaggctgatgccacctaagtgggttcctgctatcctgctacaaggaacttgaagacatcctctttcttcattggcaggacatcaagggctctggacattgtgaaagtttcccttgaagttacaatgggaatccagaacaacgtcacatggacccctccatgggtaacacagaaagcaaatggtgtcttttaagatacagaaaaatttgaattttgatggtttcattgaccaatttttccttttatagattaagcttttgttgtcatatctaagaaatctttgcctaacccaaggtcttgaagattttctcctatgtcttttttttttttttaagacaaggtctcattctattgcccagactggagtacagtggcaggatcacagctcattgcagcctcaacctcctggtctcatgcaatcctcctgcctcagcctcctgagtacctgggactacacacctgcaccactatgcacaaataattttttattttttgtagagatggggtcttgctatgttgcctatggttgtccacaactcctggatacaagcaatccttccacttcggcctcccaaagtgctgggattacaggcatacgccactgtgcccagtcctgacatatatttttaaaattttcatagatacagccaaattgtccttccaccacacaattggcatcacgtcaatttatactccaatcaggagtatggctgtttctcacttgcttggtaacactgttgagatagcaatttttttgttcctgaccaatctgatagtgaaaacatggcatctcatagttttaatagctaaaatcctactttagccacatcctaagcaatatgtgtgaaatgaccagctcgatgcattagccacccactgcttcagtatatacattactaaggaatgcaactgctaagataaaaagctaccacacaatctattgaaatactgacagaagaaattatatgatgtctgggatttgctttgaaataagccatcaatggaggtagtagatgaaactatttttctttctttttgagaccaagtcttgctctgtcaccaggctggagtgcagtgcatgatctcagctcactgcaacctacgcctctcaggttcaagccattctcctgcctcagcctccctagtagctgggactacaggcatgcgccaccacgcctggctaattttgtattttcagtagagacagggttttactatattggccaggctggtcttgaactcctgacctcaagtgatccgcctgcctcagcctccccaagtttgggattacaggcatgagccatcgcatccagccttttcttagagatgagggtctctttatgttgcccaggctgatctccaactcctgacttcaagtgatcttctcacctcagactcttaaagtgcttggattacaggtgtgaacaaacatgcccagtctgaaaactattgttactggtatttgaagcttatgacactagaaattcattatactgttttctcttttcttatctatctctgatatttttcacaataaaaacatatttttaggctgggcacggtggctcatgcctataatcttagcactttcggaggctgaagctggcagatcacttgagcccaggagtttgagaccagcctgggcaacatggcaaaaccagtctctatttaaaaaaaaaaaaaaaaagttatttatttattttttgagatggagtttcactcttgttgcccaggctggagtgcaatggcgcaatcttggctcactgagacttccgcctcctgggttcaagcgattctcctgccttagcctcccgagtagccaggattacaggcgcctgccaccacacctggctaatttttgttatttttagtagagacagggttttgccatgttggccaggctgctcttgaactcctgacctcaggtgactcacccgcctcagcctcccaaagtgctgggattacagatgtgaatcactgtgcccagcaaaagttgttttaaatgaccatttatggcaccacctaaaatcatcttgtgtacatctgtcactgcccaaccccttgaaagatgttggtttaaaggttcagagtgagggctctaggtcgggccgatcaaatgtgaatcctgattccatcaattactagctgatctcagggaagtcgcctaaccactctgggatagttgcctcagctgaaaaatcaacattaccgaaccaggttcgttctgcctgttgcacagtaagccaatcactgagatgataagttttgcagccaataaagagattattcacaaggcagcccagtgaagagataggagaacatgtctgaaatctgcatctctgaaaacagggtttagggatgtttatgggataaagaagcaaggtggtccaaggtgtagggaaaggtgattggaggtaaagaaaagtggggccattggtgatctgtgcaagccagttaagctttatggttcataggatgcatgttcagaaaatgacatcattagtacgatctaaggatggactttagggctttttggcactctaacattgaaaggtcacccatcagatactcaagcaggccgaggtgaagggtcggtgggctcagccatcttgaactggataagaactgactgtgagttcctgaaaaacaacttaagcaaccactgtcacagtgacctatacatcagagatgttatctataaggaagttgtggaagtctagttatatactgcttagctatgtgacttttagctatataggttttaaaatcaactagaagcaagtgactaaaaggaaacaaatcaaagcatgatataagctgattctttttttttttttttttttttttttttgagacagagtgttgctctgtcgcccagactggagtgcagtggcgcgatctctgctaaccacaagctccacctcccgggttcacaccattctcctgcctcagcctcccaagtagctgggactacaggcgcccgccaccacgcccggctaattttttgtatttttagtagagatggggtttcattgtgttagccaggatggtctcgatctcctgacttcgtgatctgcccgcctcggcctcccaaagtgctgggattacaggcgtgagccacagcgcccggcctgataaaaatttttaaaaggaaagaaaagaaaagcaagtaaggcaggttaagtttgtttgtttgtttttgagactgaaatctccagtgagaactttaggcaagaaattattcaggtctgtaatttgtagagataggccagtggggctttcctggaagaaggataactttaggtttgagaacaagaaaagaaggaactgaggataatgagcaggactagaagaagctctgacatgctgattattatctaaggctgttctttagtcttgcagttgcccctctgaagctcaaatctccccaaaattgcagggggatgtgctgagagctccttatggtgatctatttttataactttttttttttttgagatggagtcttgctctattgcccaggctggagtacagtggcgtgatcttggctcactgcaacctctgcctcctggattcaagcgattcttctgcctcagcctcctgagcagctgggattacaagtgcgcgccaccatgcccagctaatttttgtatttttagtagagacagcgtttcaccatgttggtcaggctggtcttaaactcctaacctcgtgatccgcccacctcacctctcagattgctgggattataggcgtgagccactatgcccagactttttctttctttctttctttttttttttttttgagatgaagtcttgctctgtcacccaggctggagtgcaatggcgcgatctcggctcactgcaacctccgcctcccaggttcaaatgattctcctgtctcagcctcccgagtagctgggattacaggcatggtatgccagggtaatttctgtattattagtagagatggagttttaccatgttggccaggctggtcttgaactcctgacctcaggcgatccatccacctcaggctcccaaagtgttgggattacaggcatgagccactgtgcccggcctataactttttttttcctacttctaattcagtatagaaaatttgaaggatacagaaaaagagactcttcctatcattgattcaggaagaggcagttgtgatgaagttgaaagagacaatcctgagttccaatctcagatctgtttcttgcattcactgtgaattttggccagtcactttagccttctgaacctgtttcttcctctatgaaagtgggaatcacagtgactcctacctcactgggtagctgtgggatgaataaaggcacatctagttcataaacacacggtgggcactcaatatatgtccttgtctcctcctttctgtttacagagaggtttcattcaagcatttcctgagcacccttaaggtgtcactacgtgccagaagacacatgagtatggacaagactggctctttctccttgaaaggcttatggatagtccaggctcagcgactcacgcctgtaatcccagcaccttgggaggctgaggtgggcagatcccctgaggtcaggagttccagaccagcctgaccaatatggagaaaccccttctctactaaaaatataaaattagctgggcgtggtggtgcatgcctgtaatcccagctactcaggaggcggaggcaggaggatcgcttgaacccgggaggcggaggttgcagtgagccaagatcgcgccattgcactccagcctgggcaacaagagcaaaactccgtctcagaaaaaaaaaaaaggcttatggtttggggagggaggaaggaggaaatcttcccagattaaatggtccaaactcctgcctcaagataaattaaaaaaaaaatacatttgacctcaatttccagatgtcagcagaggcccagagaggcaaggtcacatggcaaataaatagtaggaagggaacttgaacccgattaggaggaatattgggaaaagagcaaggaggaaggaactttgtaaataaagtcatgctagtttgtagcccaaaaaagaggaacaatagaagatggagctggctgcaaatggatcagggactggaaattcatctatgaaaatcgactgcattttttttttttttgagatggaatcttgttctgtcacccaagctggagtgcaatggggtcatctcagctcactgcaaactccgcctcacagattcaagcgattctcctgcctcagcctcctgagtagctgggattacgggctcatgcccccacactcggctaatttttgtgtgtttagtagagatgaggtttcaccatgttggccaggctggtctcgaactcctgacctcaagtgatccacccgccttggcctcccaaagtactgggattacatgcgtgagccactgtgcccagcctttttgggtttttgtttatatgtttgtttttgagacaaagtctcactctgtcacccaggtttgagtgcagtcgggcgaacatggcttattgtagccttgacctcctaggctcatttgatcctctcccctcagccttttgccaacacagctggctaatgtttttattttagtttagtagagacagggtcttactatgttgctcaggcttgggctgcattttgcttgtgcaagatttcctcccaatactatattatgaaaattttcaaacatataaagcagttgaaagaactgtatagtgaatgctcatctacccattacctagattctacaattgttaactgtttgctacatttgctttgttgcatatttattcattcatctgtttctccatctctcctcccatccatcttactattatttttttgagacagagtttcactctgtcgcccaggccagagtgcagtggcatcatttctgcttaccgcaaccttcacctcccagtttcaagcaatccttctgcctcagccacccaagtagctgggattacaggcatgtggcagcaagcccggctaatttttgtgtttttagtagagatggggtttcgccatgttggccagcctggtcttgaactcctgacctcaagtgatacacctgcctcggcctcccaaagagctgggattacaggcctgagccaccgtgcctggcctgtttatttattttttgagagagagtatctctttattgcccaagctggattgcagtggcaagatcaaggctcactggagcttcaacctccagggctcaagcagttctcccaccccagcctcctgagtagttgggactataggcatgagccattacacccagctttttttttttttttttttttttttgagacagagttttgctctgtcgcccaggctggagtgcagtggtgtgatctcggctcactgcaacctccgcttcccaggttcaagtgattctcctgcctcagcctcccaagaagctgggattacaggcgtctgcccccatgcccagctaatttctgtatttttagtagagacagggtttcaccaggttggccaggctggtctcaaactcctgacctcagtgctaggattacaggtgtgagccactgtgcccagtcccatctaatttttttgatttttgatgcatttcaaagaagttgcagagttcactacctctaaacacttcagcatgcctatcattaactacaatttactatttgtttctgaatttttggggttttgtttgtttgtttttgagacaaagtcttgctctgttgcccaagctacagtgcagtggcgagaccttggctcactgaaacctccacttcccgggttcaagcagttctcctgcctcagcctcccgagtagctgggattataggcacctgccaccatgcctggctagttgtttggtatttttagtagagatggggtttcaccatgttggtcaggctggtcttgaactcctgacctcaggtggtccatccgcttcggcctcccaaagtgctgggattacaggcgtgagccaccgtgcctggcctaggtgggtttttgttttttgttttgttttgttttgttttgtttgagacagagcctcactctgttgcccaggctggagtgcagtggcacaatttcggctcactgcaatctccacctgccaggttcaagcgattattgtgcctcagcctcccaagtatctgggatcgcaggtgtatgccaccacacctggctaatttttttttttttttgtatttttagtagaaacagggtttctccatgttggccaggctggtctcaaactcctgacctcaagtgatccgcccaccttggcctcccaaagtgctgggattacaggtgtgagccatcgaggctggcctaaatgttattttttattttacctggatggtcctaggaggcatttaactttattacccctgatctagaaagtgtattataaagccttggaagtagagttgccaaataaaatatagaatgcccagttaaattttaattttagataaacaatgagaaaaattttagtaatagtatgttacatgcaatagctgcacatatttatactaaaaattatctgttgtttatctgaaattcaaatttaactgggcattctatatatttattttctaaatctggcaacctgggaccacggacagaacttgtgtaccttatttcaaggagaagtaaacattcttaaacagaaataataagccatcacacctagccttaagtggtctctttggatccagatctcaggccctcagaagtctcgtggtgtcttctctccattaacacacagtttttcaaaccttcctctggcaagtgaaagcaaagaggctccaggaaagagggggacagcagtatgactaagtgttctgcagggaaatctggtaagaggcaggtggcatgtgggccgctggggtttttctcccaactccttccagctctgcatccctgcttcctgccctcctcctctcctaggaggcctaggaacctccttcccttgctggtgacaggctcctccaggtttctggcccctgctttagcagggctagtcctgtcctggattggcacaggtgtcataggcagaaggaaggtaaaggtggctcagttttatcaaccactgatcctgcattctgaccaggccaagaccaggctgagttctggatcagggaacttgggagctagaaccacatagcatgggagaatgaggaaatggccaggctgggattccctgccctcacaaactcggcttcttcttggacaatcaccaactacaaacccgggatgttctagaatctttacaacatcctaggaggtaggttctattagattcatttagagatttggatactgaggttcaggtgactttgcctaagaacccctgcccccccgcccccaccccacaagcaatttattgacataataaggactagatccttgatacatatgccgctgaagccgaaattactaactcctgttagatgctgcctcgcagatgagagctgacccatcctgttggcattagtaagaaggttaggatagcatagtccagtggttctcaaagtatcatgctaggtgggcatcagcattacctggaacttgttagaaatgtaatttctcagctcggcgcggtggcccatgcctgtaatcccagcactttgggagtcccaggcaggtggatcacctgaggtcaggagttcgagaccagcctagccaacatggtgaaaccctgtctctactaaaaatacaaaaaattagctaggcatggtggcgggcacctgtaatcccagctactcgggaggccgaggcaggagaattgcttgaaccccggaggcagaggttgcagtgagccgagatcacgccattgcactccagcctgggcaacaagagtgaaactccatctaaaaaaaaaaaaaagagaaatgcagtttctcggtcctaacagagcttcttgactcagaaattcctgggtgacacctagcaatctgagttttatcaagtccttcaggcgattctggtgcactataaagttttagaatcattgatatgtagtagaaagagatgccttttttttttttttttttttttttttttttttgagatggagtctcactctgtcacccaggctggagtgcagcggcacgatctcggctcactgcaagctctgcctcccaggttcacgccattctcctgcctcagcctcccgagtagttggaactacaggcacctgccaccacgcccagctaattttttgtattttttagtagagacagggtttcaccatgttagccaggatggtctcgatctcctgacctcgtgatccacccacctcgtcctcccaaagtgctgggattacaggtgtgagccaccgcgcccagctggagatgcattttttaaacaaaatgagtttcatttatttatttatattactattattagagatggagtctctctgtgttgtgcagggtggtctagaactccttacctcaaaggatcctcctgcctcagcctcccaaagtgctggaattatgggcatgagacactactcctggccaatatccatttaaaacatatatttgggaccgggcatggtggctcacacttgtaatcccagcactttgggagactgaggccagtgaatcaccagaggtcaggagttcaagaccagcctggccaacatggtgaaaccctgtctctagtaaaaatacaaaaaaattagctgggcatggtggcaggcgcctgtaatcccagctacttgggaggctgaggcaggagctaagattgcgtcactgcactccagcttgggcgacagagcaagactctgtctcaaaacaaaaaaatatatatttagaggctgagatgggaggattgcttgagcccaggagtttgaggctgctatgatcacaccattgcactccagcctaggtgacagagaccttgtctgtaaataaataaaaatgaaataaaataaaacatgtatttgttttaagtaaacttttattgatgtataatatgaatagagaaaaatgcagaaatcataagtatatggcttaattaattttcacaaagtgagaaagcctgtgtactgtcagaggcttttgaaccagagcaactccatcttgaataggggctgggcaaaataaggctgagacctactgggctgcatttccaggaggttaggcattcttcattctttttttcagacggagtcttactctgttgcccaggctggaatgcagtggcatgatcctgctcactgcaacatctgcctcctgggttcaaacaattctcctgcctcagcctcccaagtagctgggactacaggcgcctgccatcactcttggctcatttttgtatttttagtagagacagggtttcaccatattggtcaggctggtctcgaactgctgaccttgtgatccacctgcctcggcctcccaaagtgctgggattacaggcgtgagaggttaggcattctaagtcacagaatgagaggggtttggcacaagatacaggtcataaagaccttgccaaaaaagaagttagctaaaacccaccaaaacaaagatggcaattaaagtgacctctggtcatcctcactgctcattatatgctaattataatggatcggcatgctaaaagacactcccaccagtgccatgacagtttacagatgccacggcaacatccagaagttaccctataaggtctaaaaaggggagtaaccctcagctctgggaattggccacccctttcctggaaaactcataaataatccaccccttgtttagcatataatcaagaaataactctatccttagaccagcatctcgagccattgctctgactatggggtagccattcttttattcctttactttctttttttttttttagagggagtcttgctctgtctcccaggcaggaatgcagtggcaggatctccgctcactgcaacctctacctcctgggttcaagcgatactcctgcatcagcctcctgagtagctgggattacagacgtgcgtcaccatgcctgcctaactttttttgtatttttagtagagatggggtttcaccatgttggccaggatggtctcaaacacctgacttccagtgatccacccgcctcagcctcccaaagtggtgtgattacaggtgtgagccaccacgctcggcctcctttactttcttttttctttttctttttttttgagatggagtcttgctctgttgcccaggctggagtgcagtggtacgatgtcggctcactgcagcctccaccttgcctcctgggtcctggttcaagcaattctcctgcctcagcctctggagtagctggtattataggcgcacgtcaccacgcccagctaatttttgtatttttagtagaggtggggtttcactatgttggccaggctggtcttgaactcctgacctcgtgatccacccccctcagcctcccaaagtgctgggattacaagcgttagccaccacgcccggcccctttactttcttaataaactcattatcggctgggtgccgtggctcatgcctgtaatcccagcactttgggaggccgaggcaggtggatcacctgaggtcaggagttcaagatcagcctagccaacatggtgaaactccacctctgctaaaaatacaaaaattagctgggtgtggtggtgtgcgcctgtaatcccagttactcaggaggatgaggcaggagaatcacttgaacccaggaggcggaggttacagtgagctgagattgccccactgcactccagccagggtgacaagagcaaaactctgtctgaaaaagaataataaataaataacttgttttcactttattgtatggacttgccccaaattctttcctgcacgagatccaagaaccctctcttggggtctgaatcaggacccttttcctgaaacagtaacaccacccagatcagggcacagaacattattacctatcctgagaggtgtctttgtgccttcttccaggtacaccctcccctcaaagagtaaccagtatcctgacttctaacaccatagactagttttgcctaaccttacatagtttttaaaattgtaggtgaatacagaatctggagctacaggacttagggttagatccctggttcctggctgagtgatcttcaacaagccatttaatttctgtcacactcagttttcttctctgtataatggtcataaaaataccttgtactggccgggtgcggtggctcacgcctataatcccagcactttgggaggctaaggcgggcagatcacaagctcaagagttcaagaccagcctggccaatatggtgaaaccccatctctacaaaaatacaaaaattagtcagtcgtggtggcatgcacctgtaatcccagctgctcgggaggctgaggcgggagaatcgcttgaacccgggaggcagaggttgcagtgagcggaggttgggccactgcactcaagcctgggcgacagagtgagactcagtctccaaaaaaaaaaaaagcaaattctcaggccctgccccagacctactgaatcagaaactctaggagtggcctcagcaacctacagtttaactaactttgcaggcaattctgataagtactgaggtttgaaaaccactgcactagagaaactgaatgaggatggggcgcaggaatctgtattttagcaatctttcctaaggcatgttgcaggaaacatgaagtggttttgaaagtactttgcttgaggcttgaaggcttgaacctaggagtttgattttttattttttttagatggggtttcactctgtcactcaggatggagtgcagtggcgtgatcttggctcactgcagtctccgtctcctgagttcaagcaattctcccaccccagcctcccgagtagctgagattacaggggtgtgccatgcccaactaatttttgcatttttttttttgagacagattctcgctctgtggcccaggatggagtgcagtagcacgatcttggctcactgcaacctccgcctcccaggtccaagcaattctctgcctcagcctcctgactagctgggattacaggcacccgccaccacgcccggctaatttttgtatttttagtagagatagggtttcaccatgatagccaggctggtcttgaactcctgatctcgtgatccgcccgccttggcctcccaaagtgctgggattataggcgtgagccaccgtgcccggtctaatttttgcatttttagtagagatggggtttcaccatgttagccaggctggtcttgaactcctgacctcagttgatccatccgcctcggcctcccaaaccatgcccaacaaatttttgcatttttagtagagacaagatttcaccatgttggccaggctggtctcaaactcctgacctcaggtgatccacccgcctcagcctcccgaagtgctgggattataggagtgagctactgcgcccagcctttatgtttcttttgttgtttgttttttgagacagagtctcgctgagtcgcccaggctggagtgcaatggcgtgatcttgggtcactgcaacctccccctcctgggttcaatcaattatcgtgcttcagcctcccaagtagctgggattacaggcacccgccaccacacctggctaatttttgtgtttttagtagggaaggggtttcacaaggctaggcgtggtggctcacccaactctactaaaaatacaaaaattagccaggcgtgatggcatgcgcttgtagtcccagctacttaggaggctgagacaggagaatcacttgaacccaggaggcgagcggaggttgcagtgagccaagattgcgccactgcactccagcctgggcgacagagcaatactctgtctcaaaaaaaaaaaaaaaaaaaaaaagagacggggtttcaccatgttggccagactggtctcaaactcctgacctcaagtgatttgcctgccttggcctccctaactcctgggattacaggtgtaagccactgaccctagccaagcctaggagtctgagaacagcctgggcaacacagggagtccacgtctctacaaaaataaaaacaattaggatagtgtggtggcttgagcctggagtcccagctactcaggaagctgaggtgagaggatcacttgagcccaggaggttggctgcagtgagctatgattgcaccgctgcactccaggttgggtgacagagcaagactctgtctcaaaaaaaaaaaaaaaaaaaaagtcactttgaaaaatgtgactttccagatggcaaaatactattttcattaggaggaaacaggctaaacagtaatagcaaaggtcactaagtattgagcacttagtcatacctctgagtctctgcctgcatagcctattatttctcacaagcaatccatgaagaaggttaagacaacggactttcacgccagactgcctgggttcttatcaagtatgtgacttagtttatatatttgtaaaatggggataataatggtatttctgtaataggtttgttgtgagaataaagggagcttggtatcagctcttagaataccggacaggccacgttggctccactaagctgttgtcatcatccctaagggcacccagttaaaaggtagaaaagggaggatttgaatccggtcagtgtaactctcaagtgtacattttttttcttttattttctttttaaccacgccctttaatgtacattgttaaaggctaagccaggccaggtgcagtggctcacatctgtaatctcagcgattgggaggcccgaggagggagtatcgcttgagcccaggagctggagaccagcctgggcaacatggcgacaccgtggccctattcccgccccatcccatccgcactccaccccatccccatctctacaaagaatagaacaaaattagtcgggtgtggtggtgctcaactgctgtcccagctactcaggaagcccaggtgggaggctcgcttgagcccaggagtgtgaggctgtagtgagctatgactgcaccactgcactccagcctgggtgaagggtgagaccttatctcaaaaagaagaaaaaaaaagaaaaggaaaagaaaaagaaaaaagaacaactaagttataaactaagctatatagcccattggttctcaaattatgatttcactcactagcagtatcactagacagcttgttggacatgcaaattatcagaccctatcctcctatgccagatcttctgatcagaaactctgggggtgggggtcagcagtgtaagttttaataagctctctaggtgattctgatgcacaccatagtttgagaatcacagtccttataggctctggtgggcggggtgttaaaaaaaaaaaaaagcctggaggtgctgggagccgctcgcgcccatctcacctggagctgaggaaaactgggatttaactgatttaccaccgcagccagctcttcaagccaggggcgggccggacggctggcgcgcaaggcctgctggggcttgtagtctagaccacttccgcgctcaggcgcctgcgctttagctgctaactcgctctagtagctgtggtcggggctcgggaccggctgccatcttagtctagggactgaggagtcgccgccgccccgagtcccggtaaacccccgtgggcgaactcggggcagttctcgggagagggagggagtccggatgagaatgttcggggagaacaagggtagaggagtgggacgcgcggttcgggaccccagagccgcggctgctccttcttccagagccggtgtctgtcgggggcgcggggagctcgggctactggcccgggccgggcggtgggggtgggctgtctggacgttcggagggatcagtgtctggcacaggcttccggaggccttcgcctcgcgggctccaagttgtgaaagggctgggccacgacgggcgtgggtaccgtccggcccctcgcccctcagccccgcctggggccactctccagcggttcggcctacgcgcggggcccggcggcggggccggcgcgggcgacgtggccctgtgaggggcggcggccgggtcccccgccacccagctggccttctcgagacttttccgagcccccagtcgctagaagggcccagcacagcggctgcctccccttctctctcccactcgcctcctccttccattgtccccccggcgtggtggtcccggctccggcgccctccccgacgtccgccaccgtcgtggcggcgccgacttttgcagacgtggagctgtcactgcccttcctccggagagtgcccttttctttagcagagaaaagaaaaaagtagccgttgaacgtattctaagggtcgaagcatgatgacatgacttttaagtggagaactcaagttttccaagacagttcccgtccgcgacagaaaagagaatcgcagaatttgtgcgcccgaagtagacgctgggcctaaagttagttggacatgtaaccaggtgaacttgtaaagggccaggaattcattatccccaataacaacgcaaccttgttttcttggttgtattcgtatcctaatcttattacattttctgccattcttccacagctacagtatacttggtttggagtgggggatggggaattgtgggatttttgccttgaaaattagtaagaccctggagccagccacccacttaggtgggttctcctgcatcttttcctgatagaattcgatcttcaggaagtatgtaaaggcagtgtatttccattctcaaaatcggctaaggaatggtttatcagttgaggtgaagttctcatggcagatctgctgagagcttgctatgtgtatttacaggtttatttaagctacgatttatttttaaaattaagaaatgggccgggtgctgtgtgtggctcacgcctgtaatcctagcactttgggaggccgaggcgggcagatcatgaggtcaggagttcgagaccatcctgaccaacatggtgaaaccccgtctctactaaaaatacaaaaaaaaaaaaaaaaaaatcctgggcgtggtggcgcgcgcctgtagtcccagctactagggaggctgaggcaggagaatggcttgaacccgggaggtggaggctgcagtgagccgagatctcgctgctgcactccagcctgggcgacagagcgagactccgcctcaaaaaaaaaaaaaaaaaaaaagcaatgggatgggtgtggtggctcacgcctgtaatcccagcaatttgggaggccgaggtgggcggattacgtgagcccaggaattggagatcagcctgggcaacatcgtgaaaccccgtctctacaaaaaatacaaagatttgccgggtgtggtggcaggcgcctgtggtcccagatactcaggaggctgaggtgggggaatcacctgattccggggggtcgaggctgcggtgagctgttaccgttgccactgcattccagcctgggtgacagagtgagaccctgtctcaaaaaataaaaaaaaaaatttagaaatgaaggtggaaattctactgcttctttgaactgtgaatttaagttttgtgagtccaaaaggaattccattacattcagcatacaggtcaagtcaccaaggatatcatatgaaattaaaaaaatgagtacagactacttcttcagtgtattctagaatcaaacatttctacattctttagaaaaaaatacatctttttcgtttgtttgagacggaatctaactttgtcacccaggctggagtacagtggtgtgatctcggcttactgtaacctccgcctcccgggttccagcaattcttctgcctcagcctccgtagtagctgggactacaggcgcgtgccaccactcccggtaatttttttgtattttttagtagagatgggttttcaccatattggctaggctgctctcgaactcctgacctcgtgatccacctgccttggcctcccaaagtgctgggtttacaggcatgagccgccactcctggccctaaaaaatacatcttttcacttattgggagaggcagacaaaccagtagtccccaaatttgaccattagaataattaggagagcttagaaattccagggtcttaccttctgagatggatttagtaggtctgggttggcttcaaccaatttatttttaacacatgccttaggtaattctgatggtcttgggaaccactgagggcaaatggtactgtagacttaccaaggaaaggtcaaaaagctttgagacgaaagaggaagtggccaattctgtgtgtgtggctgggtggaggattggttagaagaggcaagatttgcccctgaacccacattgggtcttacatgaagagtaggagtgtgaaaagggcggggaaagagaaggacagggtaggctgagtgaatgccttaatgctgtgtgtaaattcagaggattatggaacaaaaagggttcagggagtgtggagtggaatggggaaggagagcattttgaaacgcaaggtcagaaaggttaaaggaagcaagtatatgaaaagtgattttttgttgttgagactgggtctcacccagtcacgcaggatggagtgcagtgacaggacctccagagctcaagtgatcttcccaccccagcctccctgagtagctgggacaacaggcatgcattagcatgcctggctaatttttaaaatttttttgtagagaaaggttctctttacgttgcccagtctggtcttaactcctgtgttcaagtggtcctcccaccttggcctcctaaagtgttgggattacaggtgtaagctactgtgctctggctaaaaattttaagtataatgctaaaaatttggaattttatgttggtagaaatagatacagggctgggctcagtgcctcacacctgtaatctcaacagtttgggaggctgaggcgggtgaatcgcttgagctcaggagtttgagaccagcctgggcaacatggtgatatcccgtctttaccaaaaggaaggaaaaaaaaaagaaatagatgcagatttttcgacagggaaatgatgtgagtacatatgtgttttagaaaattgctgtgtactgcaggacaaagataggtatcaaaaaacaaaaaaagaaagattgctctggtgatgagcgaaaggatgagggactagctattgcagaagtctagttgagaaatgacaaagcctgaccttggagagaggttgtggggatgatcaaaggattggatttagctttttactagtgcaatattgttgccatatttctagatgaggatttttttttagagctaatctgggtaaagggctccttttctgtcaaaagaacccattagcaagtctgaataatattgccaggttatatatgttatgtatagtatgagagtgaattgttcattagcatctttgagaaattagaaagaactatgtcaggtgtaatttggaagagaacttgaagtttgttattgttactatttttgagatggagtcttgctcggccatgcaggctggagtgcagtgatgtgatctcggctcactgcaacctccacctcccgggttcaagcgattcgtgtgcctcagcctcccaagtagctgcctcccaagtagctggaattagaggtgcatgccaccaagcctggctaatttagaacttggagtttggactgaaatttatgcctctaaaaagtattgatctaggcttgttgggagtgtttttctctcagcctgtagaaacttgctcattgagttttagagttgggagaagttacagagattatctagtccataatggcaaatatattttggtttattggccagctctaattggaagctgccagaagcactgtgtttggaaggattctggttgtaggtgctctgagaaattgtattatggttgatcaatgatgtctcctgtggacagttacctagtaggtagtagacatgtgccaaatatatgctattcttagataagtccaatctcttagttttctgttttgttgttgtttgtttgttttaaaggttaaataatttacctgaaactagttaagagtaagaactagaactagaactgggttttgcaactctgggactggtattctctggtttacaaagatcaatgtgcactactgaagagcttctggtattagactagaaaaagaaaagggagatttttagcctatgcgtcttgactgtttaggcaagagtttaacaaggaattttggcctagaagtaagttttgttatattcattctgtcttaagaaatttgtgttagggccgggcgcggtggctcatgcctgtaatcccagcattttgggaggctgaagcgggcagatcacgaggtcaggagatcgagatcatcctggccaacgtggtgaaacccccatctctactaaaatacaaaaaattagctgggtgtggtggcatgcacctgtagtaccagctacttgggaggctgaggcaggagaaccacttgaacctgggaggcggaggttgcagtgagctgagattgtgccactgcactccagcctggcaacaagaatgagactctgtctcaaaagaaaaaaaaaaaaaaattcgtgttagtactgataggaaatagtcatctgttttgttgttttgccactttctttcttgttgcctaagtctctgttttgggttttggacattggtttcctttataagaattaagacaaaagtatgtaaggtttttttttttgtatttatagtacttagccaaattctgggctcataataagcactcagtaaaggcatgttgacttttatggctgtaaatgatactggctttgagtcaatataaattagttagggggttcacagaattgaattgcagcattctctggttgggaggttggctttcagctaaaaacgttaagttggaaactatcctcacaactagaagcagttaaccagaagctgttcctgcctctatcctcctccagtctagcagtgtactgtccttgaaaaactgctgccagctcagcttttttgcttcttttcagaactgactatatccagatccttggtgtgcgttttcttttcctgtccctaggagtctccaagttgcagggactatcattatggtgacccttataggctggtgtatttatatggccatcctcattttgccagatagccgtcatactcagattggtgtcttcccataatacgtatgaatcattttccctcagttctttcttttgtcctgtctgctccattaaaaattgtctatcccatgaaatttttaaaagagactttgtgcttttagagtcgcaaggtcgttgcagatctgatgtgtttaactatagaggtcagctgggtgtggtggctcacgcctgtaatcccagcactttgggaggctgaggtgggtggatcacgaggtcaggagttcaagaccagcctgaccaatatggtgaaaccccatctctactaaaaatacgaaagttagccaggcgtgggggtgcacgcccgtagtgtagtcccagctactcaggaggctgaggcagaagaatcgcttgaacccaggaggcgaaggttggagtgagccaatatcatgccactgcactctagcctggcgacagagcaagactccatctcaaaaacaaacaaacaaaaaaatatagaagtaatgtgttaatggactctccttcctttctcaggtaccatgcatttcacggtggccttgtggagacaacgccttaacccaaggaagtgactcaaactgtgagaacttcaggtatggtgtcatcctgtgagagaaattgggggcaagagtgatgcagaggccaagctctggtcttatacctgctgtgaggagagagcagtgttgatgctagctgcatcagttggttgaacatataggcagcttcacttggttctgaaacccaaagctgcctctgcagggattagcctgtgagccacactgtgctcttaatttgggttttctgacttttctgtttttgtagatcccttatacatatgcatactttttctatttgtgttgttttatacacgtttatctctgtatactatctagacatgtgcatgtgtaggattaagaggtgggtaatgaaaaagaagacaacatggccaggtgcagtggctcatgcctgtaattccagcactttgtggggcgaaggtgggaggatcacttgaacccaagagtttgggaccagcctggacaacatggcgagaccctgactccacacaaaataaaaaaaaatcagctggtgtggtggcgtgtacctgtaatcctagctgattgggagggtgacatgggaggatcacttgagccaggaggttgaggctgcagtaagccatgatcacgccactgcactccagcctgggtgacagagtgagaccctgtctcggaaaaaaaaaaaaaaaaagacaacatggttcagtgcagaaagaatagaggacttggaaagaaaagatctgggttccgatttgattttgccactgacaagctgtgtgactttcggcgagttatttaatcttgccagacctcagtttatacatctgtaaaataggtaagtattgattcctgtctccatccctggcattgttgtgtggatcaaataaaataatacctattaaatctttagaaaaggaaatgaattcatgacttaaaatgttatcttggccaggcacggtggctcatacctgtaatcccagcactttgtttgggaggccaaggtgggcggatcacttgaggtcaggagtttgaaaccagtctggtcaacatggtgaaactccatctctactaagaatacaaaaattagcagggtgtgatgtcatgtgcctgtattcccagttacttgggtggctgaggcaggagaatcatttgaacccaggaggtggacactgcagtaagccaagatcgtgccactatactccagcctgggcaacagagtgagagtctgtctcaaaaaaaaaaaaaagaaaagaaatgttatctagatccacaaggtgagagaagttgagagtagtattgtgaaggaaaacatgaggacaagacagatcactttaaaaggtcaggagagaaggaagactactgggtaagaaaaaaaaagtagaacataaagttaagcagtaagagaatagggagtgaatgaagttgagcaggtgaattgttagataagaaagctgaggctgggcgcggtggctcacgcctgtaattccagcactttgggaggccgaggcgggtggatcacgaggtcaggagatcgagaccatcctggctaacaaggtgaaaccccgtctctactaaaagtacaaaaaattagccgggtgtggtggcgggcgcctgtagtcccagctactcaggaggctgaggcaggagaatggtgtgaacctgggaggcagagcttgcagtgagccgagatcacaccactgcactccagcctgggcaacagagccagactccgtctcaaaaaaaaaaaaaaaaaaactgaataggaagatactggtaaaatagaactaaaatatgatccagcattgccacttttgggtatatatccaaaggaaataaaatcacttcttctttttttttttttttttttttttgagatggagccttccccaggctagagtgcaatggcacgatcttggctcactgcagcttctgccccctgggttcaagtgattctcttgtctcagcctcctgagtagctgggactcgggaggccaggcgtgcacccaccacacctggctaattttgtattttcagtagagacggggtttcaccacattggccaggctgctcttgaactcctgacctcaggtgatctgcccgcctctgcctcccaaagtgctgggattataggcgtgagccactgagcccggtcctgttcttttttataatcaagagaaaggaaggagatggtggaatgatttgtgatagctactataaagcaatttaaaaaatatttaaaagtattattaaagtatttaaaatatctttaaaatatttctcagcatatccatttcatctcaagctcacaaagcagttctttgtggaaaggtatttgagccaacattcaggaaacctgcgttctaccattggtattactggtcacttaaattctgtgatcttgggcagctcacttaaatctccctgggcctggtttcctcacttatctattgaatgttttgaatatgatttctcaggttctttccagctcactctattatattctgtgctttatgtgctaactcactgatttttcatggctttgttgacatcacaatatatgactgatatcagaaatatcttataataaggcttcggccggccgcggtggctcatccctgtaatcctagcactttgggaggctgaggcgggcggatcacgaggtcagaagatcgagaccatcctgactaacatggtgaaaccccgtctctactaaaaatacaaaaattagctgggcgtggtggcgggcgcctgtagtcccagctactcgggaggctgaggcaggagaatggtgtgaacctgggaggcggagcttgcagtgagccgagttcacgccactgcactccagcctgggcgacagagtgacagagggatactttgtctcaaaaaaaaaaaaaaaaggcttcataatgtctgatgctttataaatgagaaaccatgttattttaagttctacttttttttttttttgagagggaatctaactctgtcacccaggctggagtgcagtggcgcaatctcagctcactgcaacctccgcctctcgggttcaagcaattctcctgcctcagcctcctgagtagctgggattacaggcacccgccaccatgcctggctaattttttgtatttttagtagagatggggtttcaccgtgctagccaggatggtctcgatctcctgacctcgtgatctgcctgcctcagcctctcaatgtgctgggattacaggcatgagccaccgtacccggccttttaagttctactttaaacattggcactgagagacctgtaggaaacgtaagtatagaaagtttaagtttgtaatatttgacaaggatctgttgagctgctattgtgctaggttccaaggggtactcaaatataaaactcctggtttaaggattttgtcaggaaaacagacttccttgccagtgattgattattataaaaaggaagttggtaaatgttacaagagtttcattgcattgcaatttaagaaattaagttcagattttttggttcctttaacatgattgaatgtattccttttttttttttttttgagacggagtttttctcttgttgccgaggctggagtgcaatggtgcaatctcagcttactgcagcctccacccactgggttcaagcgattctcctgcctgagtctcccaagtagctgggattataggcatgtgccaccacgcccagctaattttgtatttttactagagatagggtttcactgtgttggtgaggctgatcttgaactcctgacctcaaataatccacctgcctcgacctcccaaagttctggattacaggcataagccactgcacctggccaaatgtattttttttttttttttgaggcagagtcttgttctcgcccaggctggagtgcagtggtgtaatcttggctcactgcaacctccgtttcctgggttcaagccattctcctgcctcagcctcctgggtagctgggattacaggtccctgccaccatggccagctaatttttatatttttactagagatggggtttcaccatattggccaggctggtctcaaactcctgacttcaggtgatccgcctgccttggcctcccaaagtgctggaattataggcattcggcctaacataattgaatgtattttaagtgctgctgtatgctagacattgcagggacttatggtgaaaaagcaatctctgccctccagcaactcgcattttttttttccatgtctggaaattgcttaccctaatagatctatccttctgtcccagaaaagagaagaattttaatactatgtcgtcacttacaggttaagaattcatctacatattgagcttaactcactccagaaatatctactaacttgcttgctttctgagaaaatgtttattattttactggattctgcaaccttttctttgtcagttacaagagaacattttttttttttatttttttttaagatgcagtcttgctttgtcgccaggctggagtgcagtggcacagtcttggctgactgtaatctccgtctcccaggttaaagcgattcccctgcctcagcctcccatgtagctgggactacaggtgcccaccaccacgcctggctaattttttgtattttagtagagacgaggtttcaccatgttggccaggatggactttttattttttatttttttaagacaagataagctccagaaataaccatctgcatttaggtgaactttgatttgcttgttaggccttcattcgtgcaaagaaagagtaggttctacaattttgtcttgattatttttccaaataatcaaatttagttggtcacaaaggaaaggattttagtctaaaggattatattgtaggagttaacagtatttactggagttaggttgattttgaattttgactctactgtgtagtggtggtatgatcttggccaacttgcctaacttctttttgccttagttttctcatctgtaaattgggaatagtaatagcatatatacataggtattatgtgtttctgcttgaacaagacttggctcacagtgtgaagtgttagtcgttgttttcattatcatcattaccatcaaccttatctttcttaaagttatgatctgagttcataaatcattcagtaaacctatttaggctgagcattgtaaatttaaatgcctgcaagggctggatgaacatttagtaagtaatgacagatcagactgggactttaagtgaactagggaattcattcccctccaagggagcagctgttaaagcagctttggcttacaattttttttttttttttttgagacagagtttcacttttgttgcccaggctggagtgcagtggcatgatcttggctcactgcaacctcaacctctgcctcccgggttcaagcaattctcctgcctcagcctcccaagtagctggaattacaggtgctctccaccacgcctggctaattttttgtatttttagtagagatagggtttcatcattttggccaggctggtgttgaactcctgacctcaggtgatccacccgcctcggcctcccaaagtgctgggattacaggtgtcagccaccacgcctggcgtgatttttttttttttttgagacagaatctcgctcttgttgccccagctggagtgcaatggcgcaatcttggcttaccataacctccgctttccgggttcaagcaattctcctgcctcagcctcccaagtagctgggtttacaggtgtgtgccaccacgcctggctaattttgtatttttagcagagacgaggtttctccatgttggtcaggctggtctggaacttccgacctcaggtgatccgcctgcctcggcctcccaaaatgctgagattacaggcgtgagccaccgcacctggccttttttttttttttttttaatggaggtaaaagtaagtatgtgaggttatgtatatgttatttagctcgatttagccattccacaacatgtacatattttaaaacatgttatgggctggtcatggtggctcatgccataatcccagcactttgagaggctaaggcaggaggatctcttgaggccaggagtttgagaccagcctggataacatagtgagaccccatctttattttatttcaataaataaataaaacctgttttacatgataaatatataccttttttgtcaattaaaataatttaaaaatactacttaaggtcttgggaatacactcacaatgtattggtagttaaaatttttttttttttttttttttttttttttttttttaccagttgctgtggctcacttctataatcccagcactttgggaggccaaggtgataggattgcttgagcctcggagtttgagaccagcttgagcaacatagcgagatcccgtcattatatttttcaaaattaaaaaggaaagttttcagaaggttaaaaaaaaaattgaggcaaaattcactactttaaagtgtacaattcagtgttggcttactattgaccttggggagagtgcagaccatgtgcagactgaacatcttaatttttttctaaggagaagctagaaatcaagattttgtaagaaatttttattgttaaatgttggcaacttatgaattcatagtgtaaacactgtgggccaaacaaattaccactgtgggcagaatttgtcttgtggcttgctgctttacaacctctgatctggggcttgactttctgcagcataacccatgttttctgccctctgagaagaaagttcttacccacgtaaagatttaaccagcctcggcagcatggtgaaacactgtctctacaaaaaagcctcataaaaatcagccaggcatgatggtggtgtgcgcctattgtcccagctgaagtgcaagggtcgcttaagcccaggaggttgagactgcagtgagctcatgtcgctgcactgatatcatgtcactgatatgtcactgcactctagtctgggcaacagagtgtgaccgtgtctcaaaaataaatacataaataaataaataaataaaacagttcaaacaatacctcaaagcagtctagtactgaatgagaggtatgtagaataattattaaggcagatagaaggagggaagttagttagttattcagaatatgccaaggtgcagaggcaggaatggacttcagggggtggagtttaattttagaggatttgtgtgagcctggtaataggcaaaagttttgaaaatttgagaagagtcaagcctcttattttgaataaccttgagacctattggctgataggattaaatggtattttgtgaagatttatttggcaaaattgaggtctgtagtatttactatggttggaggcagggagactaggctatggaggtgtcagtgggaatgaaaataaagggggaaaagcttgtataagagacaaaaggttgcattaaagagggccaattttgaaagctttttctctattgacttttgtacaaactgggatatgggaagatactgtgtacaggctatattcctcttttcatgttgtgaatcttgctttatcccttactcagtcccaacagtgtccttgttgatggattacatacgttttcttacgatttcccagcttgcacaagtagaatagaaagaaaaaccaggccaggcatggtggctcacacctgtaatcccagcactttgcgaggctgaggtgggcggatcacttgaggctggagtttgagaccagcctggccaacagggcgaaacctcgtgtctactaaaaatataaaaaattagccgggtgtggtgttacactcctgtagtcctagctacttgggaggctgaggcatgagtattgctggaaacagggaggcggaggttgcaatgagccgagattgaactgctgcactccagcctgggcgacagagcgagaccctgtctcaaaaagaaaaaaccaccaaagtagtgtaattgctcatcacatttcttgtttggggtttttggttatctcggttaacctctggtatatttcattagaccttagtttatacattgaattttcatatttaccaaggtttggaaacaatgacaaatggcttgctcttagaaagatgtagaattttcttgcagaaacttgagataactgatatggctgggcgcggtggcttacacctgtaatcccagcactttgagagtccaaggtgggcagatcgcttgagcccaggtattcaagaccagcctgggcaacatggagaaaccctgtctctacgaaaaacacaaaaaattagttgggcatggtggcgtgtgcacctgtagtcccagctacccaggaggctgaggtgggaggattacctggtcccgggaggtcaagactgcagtgatttacctgtgattgtatcacagtactccagcctaggcaacagagtgagaccctgtctcaaaaaaaaaaaaaaattatgattcagaatgtctgaagaaaccaataaatgtagaaaggtagaatatgttcagcataacctgagaaagtgatttttaggatgttattttctaaataagatttagattttgttctgtttatacttctcatgaaacttttttttttttttaacatacctgggaagttattcctcattcttggccaaatacaaaatgtcattattttagagactatagtctttttcgcaagtaagctgaatagtgtgttaggtatagtctgagtattaagaatatctgagatctgtattaaaaacagatgtaggccgggcacagtggctcacgcctgtaatcccagcactttgggaggccaaggcgggaggatcacctgaggtcaggagttcgagagcagcctggccaacatggtgaaaccccatttgtactaaaaataccaaaaaattagccgggtggggtggtggcgcacctataatcccagatactcggtgggctgaggctggagaattcctgaacccaggaggcagaggttgcagtgagcagagattgcgccattgtactccagcctgggcgatgagcgaaactctgtctcaaaaaaaaaaaaaaaaaaaaaaagatgtaaaaaaaaaaaaagaatatctgagatatagcaaagtttttctcatggatgaataaaaatactgaactgggcctttaaaaaagtacagaaaattgcctgtcatagaaatgcagcagtagggtcaaatgagctaaatctaaatctcatttaatgaaaaaggcactttccttttatttttgaaggatggtctaacctagtttttggaattcatttgttctgcaattaaaagagatttttaggtggttcatttaattatagctgttttggaaatgggaaggaaaataatgtgagagagagattaactgcatttgcttctgtggaaagtcagtagtcaaaaggagagtctggattatttatttatttatctaaaaatatggaacacttggtgaattttaaccttatctttgctcagaggatgtactaatctctgtgttctaattttttagtatatgtgctgctgaagcaaacacacagattatttttttctgttcttaagttttttggaggaaagctatttactataggtcttaattaaaaactatattctgtatatattgaaatgtgcagaaccctgctgctgctgtttttcgttacccagaatgttgcttacatctctctactatcatcttctctccctttgttttagcccttggggtttatgtttttttattcctttatttcatttttttctgaggttttggaagggaatggagaatggggtgtgttcattctgcctggctggttgattttatatagaaattgatgttttcatctctaagggacaaagaaaattaggaaaatatcctagttttatttttattgtggtaaaatacacattacatacagtttaccattttaaatattgttaagtcttcagttcagtgacattaagtacatttaccttgttatgtgaccattaccactatcggtctctagaactttttcatcatccagaactgaaacttgtacctattaaacaataattatccatttcacctcctccctgctctggtaactactattctgttttctgtctctgtgaatttagctattctaggcacctcatcgtaaaagtggagtcatacaatatttgtcctttttttttttttttttttagacggagtctcgctctgtcacccaggctggagtgcagtagtgcgatcttgactcactgcaacctccgcctcctgggttcaccccattctcctgcctcagcctcccaagtagctgggagtacaggcacccgccaccactcccggctaatttctttttgtgtttttagtagagacagggtttcactgtgttagccaggatggtctcaatctcctgacctcgtgatctgcctgccttggcctcccaaagtgctgggattacaggcgtgaaccactgcacccggcccccccccccctttttttttgagacagagtctcgctctgtcaccaagctggaatgcagtggtgcgatgttggctcactgcaacctccgcctcccaggttcaagcaattctcctgcctcagtctcccgagtagctggaactacaggtgtgtgccaccacgcccagctaatttttgtattttttaatagagacagggtttcaccatgttgaccaggatcgtctcaatctcttgaccttcctcagctgggattacagccgtgagccactgcgcctggccaatatttgtccttttgtgtctggtgtatttcacttagcataatgtcttcaggtttcatgttgtaccatatgtcagaattttattcctttttaaatgctgagtaatattccattttatatattttagtaattttttgaaggactgaataggctcaagtacagcaatgacatattttttgttcatttccctgttatcttttttgctgtgaactgtgattttaaatcatgaaattaacattgaactatgctagagatactagttttgggccacatcttctgttctgaccttaggtaatccactttgcttgggttgtttgtcttactcagttgtaagagtttattgtaaattctggatacaactcctttatcagatatgtgttttgcagattttatctcctagcctattgcttgtctttccattttcttaatgatgtcttttttttttttttttttttttgcaaaaatagagatggggtcttgcattgttgcccaggctggtcaaactcctgggctcaggtgattttcctgcctttgcctcctaaggtgctatgattacaggcatgagccaccggccctgcccaagaagttgagtgcaatcaaaattagaaactttgacccttttttaatttatttttgagacagagtctcactctgtcacccaggctggagtgcagtggcacaatcgtggctcactgtaatctccacctcccgggttcaggagattctcctgcctcagcctcctgagtagctgggattacacgtatgtgtcactgcacctgggtaatttttgtatttttagtggagatggagtttcaccatgttggccaggctggtcttgaactcctggtctcaagtaatctacctgcctcagcctttcgaagtgctgggattaccggtgtgagccactgcgcctgtttgaaatttcaactctttagaagacatcattaagtccaggcatggtggcttgcgcctgtaatcccagcagtttgggaagctgaggcgagaggatcgcttgagcccaggagttggagaccagcctggccaacaaagtctacaaaacgaaacaaaacaaaaaaacaactatctggacgtggtggtgtgtgcctgttttttttgtttgtttgttttttgagatggagtcttgttctgttgcccaggctggagtgtggtggcgcaatctcagctcactgcagcctccacctcccaggatcaagtgattctcctgctgggactacaggtgtgtgccaccatgcctggctaatttttttttttttgagatggagtcttgctttgtcgcccaggctggagtgcaatggcgcgatctctgctcaccgcaacctccgcctcctgggttcaagtgattctcctgcctcagactcccgggtagctgggactacaggcgcacgccaccatgcttggctaattttttgtttttttagtagagacggggtttcaccatgttggccagactggtctcaaactccttgcctcgtgatccgccctccttggcctcccaaagtgctgagattacagacgtgagcgaccgcgcctggcgtgtgtgcctgtatgtagtcccagctatttgggggagaatgaggcagtaggatcccttgagcccaggagttccaggctatagtgagccatgatcacaccactgtaccctagctctgtcaacagagcaagtccctgtctctaaaaaaaaaaaaaaaaatggaaagaaatactcaaaacactcaatttctcaattgttttctttaatgaataacgtgtttggtgtcatatctacaaaaatctttgccttactggacaatcagtaaatctttcttagatttccatttgtttacctgtgagaacaaataagatgtatgtggtattttgccttctttggaatagtatttctattctgtttctttttgaatttaatcggaggggctaatcttgggatagaatgctaaggtgaaaatctacagactcaaattggaatgtagaattgactttgctttcataatcctagttgtttcctaataggtaagtggtaatttggttcctctccccttcctagtattgagggctcttggatgtaaactcttatttgtgtcattttattctaggtttttgacacaatctgaataacaatgctttttggctccttttaaggaaaatgcatgaattttgttaataaagtgcatatacatattactcagtgactcagtattgactttcagtttacttgataattcttttttcttttcttgagatggagtctcgccttgtcacccaggctggagtgcagtggcgtgatctcagcatactgcaacctctgcctcctgggttcaagtgattctctgtctcagcctctcaagtggctggaattacaggcgcctgccaccatgcccagctaatttttttgtatttttagtagagatggggtttcaccatgttggccaggctggtcttgaactcctgaccacaagtgatccacctgccttggcctcccaaagtgctgggattataggtgtgagccaccacgctcagccaataattctttttattattactattattattattattattattattattattttgagacagagtcttgccttgtagctcaggctggagtgcactggcatgatctctgttcactgaaacctctgcctcctggcttcaagcaattctcctgccttagcctcctgagtagctgggattacaggcacgcaccgccacgcctggctaatttttgtatttttagtagaaacggagtttcaccatgttggtcaggctggtctcaaactcctgaccttgtgatccgcctgcctcggcctcccaaaatgctgatattacagccatgagccaccgcgcccagtccttttttaaattttttttcagacagggtcctactttgttgctcagccgggaatgcagtggcatgatcatggctcactatagtcttgacctctcgggctctggcgatgctcctgtgtcagtctcctgagtagctgggaccacaggtgcataccaccatgcctgggtagtttatttttattttttgtagagatagtgtcttgctatgttgcccaggctggtgttgaactcctggtctcaagcgaccctcctaccttgacctcccaaggtattgggggtgggattacaggcgtgagccaccatgccagtcttgggcttgatagatttttttttttttttttttttgagacagagttttgctcttgttgctcaggctggagtgcaatggtgcaatcttggctcactgcaacctccgcctccttggttcaagcaattctcctgcctcagcctctcgagtagctgggattacaggtatgcgccaccacgcccagctaattttgtattatcagtagagacagggtttctccatgttagtcaggctggtctcgaactcctgacctcaggtgatctgcctgcctcggcttcccaaagtgctgggattacaggcatgagccactgtcactgtgcctggctgatatatatatgtgtgtatttattattattttttttaatagaaatggggtttcactgggttggccaggttggtctcggaactcctaggctcaagagatcctctcaccttagcctcccaaagtaccaggattacaggcatgagccaccaggactggtctgtaattcttttttttttttttttttttttttgaggtggagttttcactcttgttgtctaggctggagtgcagtggcacaatcttggctcgtcgcaacctctgcctcctgggttcaagctattcttctgtctcagcctcccgagtatctgagattacaggcatgcaccactgcacccggctaattttgtatttatagtagagacgggatttattcatgttggtcaggctgctcttgaactcctgacctcaggtgatccacctgcctcagcctcccaaagtgtttttggattacaggcatgagccactgtgtccggcctcttttttttttttttttttttaagtcaagtgaagcagtgggagtggagaaggaacaaagaaatctgtaactggttgtgatcagttagttgtaaataccagtgcagcagttggaccagccgaggcctgtaattcttttttttttttttttttttgagatagagtcttgctctgtcgcccaggctggagtgcagtggcgtgatcttgtctcactgcaacctccgccttccggcttcaagcaattctcttcctcagcctcctgagtaactgggattacaggcatgcgccaccatgtccagctcatttttgtatttttagtagagacggggtttgaccatcttgggcaggctggtcttgaactcctgaccttgtgatccacccgcctcagcttcccaaagtgctcagattataggcttgagccgccgtgcccagctgcctgtaattctcaaataatgtttagaaatgatctgaggaaagtttgctggaaggatgaggcatggtggatattagggtcttttttttttttttttttttgagacggagtctcgctctgtcgcccaggctggagtgcagtggcatgtcctcagctcactgcaagctctgcctcccgggttcttgccattctcctgcctcagcctcccaagtacctgggactacaggcgcccgccaccacacctggctaattttttttgtatttttagtagaggcggggtttcaccgtgttagccaggttggtcttgatctcctgacctcgtgatccacctgcctcggcctcctaaaatgttgggattacaggcgtgagccaccgcacctggctattagggtcttatattttgagaatgtatagatatttagagatggtcagaaacaagaaaattttttttttttaagaccgagtctcactctgtcgctcaggttggagtgcagtggtgtgatctcagctcactgtaacctctgcctctgagattcaagccattctcctgcctcagcctaccgaggagctgggaccacagtaggcacatgccaccacgtccagctaattttatgtgtgtgtgtgtgtgtgtgtgtgtgtgtgtggttttttttttttttttttttagcagagatagggtgtcactatgttggccaggctggtctcgaactcctgaccttaggtgatccgctcaccttggccttgcaaagtgctgggattacaggcatgaagcatcacctctggccagaaacaaggattccttagagccaggaaattcaacattatatataattagatgtataatttcacacaagcattgtttgcaagagaacaatacttatagtagtacaacaatatttatatttattgtggcaaatgctttaaactctagcagtagtcaaagctagaaacaacttgtaataatagttaattttgaaatgtttgtcagaaagctgtttgtcagaaaggggaagagatcaccttctggaatattaggtacagagttcaaaccagcaaatgaatgctaaaagttagatcctggtgccaatttccttaaattctgtgttcatactgttgaacctcgaaagttgtagcttcctctttttctctttgaacagtataattgtccttttttgcatatgctttagaatccatactgatgtatttggttggaaagtgggaaaggagcttttagtgttctgagatcattgtgtgatgttcagaaccaaagtgtcactgttacatggtagagaatggttcatattctacctccttgttaagtcaattaagtcaatttttcctagtaaatgggaaagcaaccgccttccctatcatgaggggttttgggtttcttcccacttgctttgctgagaaattaaattatggaaatgggtatttaccctctgctccaatctaaataaacttttattccttctaccaataccttcagtagcccatgcaccaaagtcggctcctttgtttttttttttgttttgttttgtttttttgaggcagagtcttgatctctcgtccaggctgtagtgcagtggtgtgatctcagctcatggcagtctctgcctcctgggatcaagcaattctcagcttccaagtagctgggatcacaggtgcctgccaccacacctggctaaggtcctttgtgattattagcagagaatgggatctaaaaatgttcctgtgttccttctagctagtctttgctactgtgcccctagataatgggatctagtttttcacttgagtagtgtttttgggaacatgacagagtagccctgtccaagggagacatactactcggtatgtatttctaatttaccacacatgcttctgtattttatagtaagattgtttgagagtttgacttcattagggtttagttctctgaataccactatatactttagctctttgaactctggactttctgtcacaagcagtttttctccttagtttttttgtgtcttctgaaatgtcattttggtggattcttttaagaaaatatagggctatattaaattacttaaaggttttctaagtcacaatagatgtggcctgtaaaaatatctgattatgttgggtgtgttatttctgaaaataaaccaagcaaatttcacaatatcctgtttaataatttctctataaataagatacatatttaaaataaggctataaatgtttgttgcttaagagacaagatattactgaaattatcttctgaagtatgtctatccctttccacatttttgtttccactgccttttcagtaagatgttaaggttaattttacctctggcagtgttttagcaccttctttctatattgggcattctatctgtcacatttttctagtgtagtagtaaacattactcaaaataaatgatttataggccgggtgtgatggctcatgcctgtaatctcagcactttgggaggccgaggcgggcagatcacctgaggtcaggcattcgagaccagcctggccaacatggcaaaaccccatctctactaaagatacaaaaaaaattagccagatgtcatgcatgcctgtaatcccagctactagggaggctgaggcaggagaattgcttgaacccaggaagcagaggttgcagcgaggggagattgcgcccctgcactccagcctgggcgacacagtgaatgtctgtctcaaaaaaaaaaaaaaaaatttataaagtgctaagtattgacccagctgggcacagtggcttatccttgtaatcccagcactttgggaggccaaggcaggaggacgacttacttgagcccaggagttcgagactagcccgggcaatatagtgagaccctgtctctatctccctgtaaaaaattagatgggcctgtggtatgtggctgttagtctcagttactcaggaggctgaagcaggaggattgtttcagcccaggtggttgaggctgcagtgagctcgatcactctagcataggcaacagagcgagaccctgtctcaaaaaaaaaaaaaaagaccctgttttgagtttctttgtaactgacagactaataggtaatagagttttaaaatattgttactagatttttttttttcttttttgagatggagtctcgctctgtcacccagactggagtgtagtggtatgatcttagctcactgtaacctccgcctcctgggttcaagcggttctcttgcctcagcctcccaagtagctgggattacaggtacctgccatcatgcctggctgatttttgaatttttagtggagatagggtttcaccatgttggacaggatggtcttaatctcttgaccttgtgatccacccgcctcggcctcccaaagtgctgggattacaggcgtgagccacagcacccagccatgatttagattcaaactgtatcttcattggttccagtcacaatggtttacagtgctaagtaaagctatagattgcatactgctgtacttgtgaaggctttttttttttttttgagacacggtctcactgtgttgcccaggctggaatgcagaggtgcagtcacggttcactgctgcctcaacttcctgagttcaagcggtcctcccagtttggcctcccatgtagctgggactataggcatgcaccactgcatctggctaatttttaaattttttgtagagatgggagtctcactgtattgcccaggctggtcttctgaaggcttttagtttgtttgtttgcttgtttgtttttaaatcttgtttgcttgcttttcttttctttcttttctttttttttgagatgaggtcttgctctgtcgcccaagatggattgcagtggccttatcacagctcactgcagcctctacctgctggtctctggcgatctttgtgcctcagcctccccgttaactgggacaacaggcacataccaccacatccagctaatttatttttattttctgtagagacaggattttgctctcacatatctgtccaaccaataaacaaaaaagttatgatactcagggcaaagttttctctaactcctcaaaaggacttgaatttaggacatctttcttactgagacatacaaaggcttaaaagtatgtattacaatccaaaacactcaccactgtctaacatttctcctccaaatgagagcactaatagcctattcaaaagagtctctaattatgaatgtgaagttacaaagaatgtttttttgttcttaggtctatgaagataacacaaaggcaacaagtgaaaacacaatgcataaagtttcactttagtccccttataacagaaaacaagagatgaagataagagcacttttgctgtcctagaacttaaaatgaaaatctaagagagacccataatataaatacaatcatcccttggtatatgtggggattgcttctaggaccaccacatataaccacgtcagtgcatgctctgaagtacgccctgtggaacctgcgtatgtgaaaagtccttcccatagacttgggtttcacatcccatgagtactgtattttcaattggtgttttttatttttattttttattattttttaaaaaattttaattaaatagaaatgaagtctcactatgttgcccacactgctttcaaccttctgggctcaagcaaccctccctgctcagccttccaaagtactgggattacggacgtgagccactgctcctggcctcaatctgtgtgtggttgaaaaaaggctgcatataagtggatctgtgcagttcaaaccagttgttggacaagagccaactgtaattagaattataaaaattgatgccatgctctctgtgtgagtaacaatgcagtaagaatatgcagattttagtcactaattttgacttcctgggaaaggaactgcagactagatgctacaaaagagaaacacttgagggtgaaaaagattaactgtaagaaaatgggaaagagactaagaaatccagtttcttagaaaaacatattcagtagaaacttaggaacagaagtgatgtcttggttggccatgagatagtagatccctacaaccactagaaagtgtccattagggacattatccctttagggtaatgtgcaggtggtcatgtttcagactttattactcaaagtcatgaccactggggaggttagataagcatctttttaaggggttatctatgttacaggcattgtttaaagactctgctgaagaacaccttggtatgcaggaatcaaacattggtcagggccaggcactttgggaggccaaggtgggtggatcatttgaggtcaggagtttgagaccagcctggccagcatgatgaaaccccatctctactaaaaatacaaaaattagctaggtgtggttgtgggtgcctgtagtcccagctactggggaggctaaggcaggagagtcgcttgaacctgggaagtggaggttgcagtgagctaagactgtgccactgcactcagccagggcaacagagtgagactctgtctcaaaaaaaaaaagaaaaaaattggttagcatgatggtttcacttcaagatggcatcactcttgcatgcaacaggcagttttcctacaactgtctttaattctgcagatactctgtcagtctttaaaatgaaactataaattatagattatctacatttatggatgaagaaagtgtggcttagagaaattcagtaatttgctcaagttcacagagtaacagttcaggaatgttgatctagatctgtctgacttcacagttggcatacataattaccatgctataatgtcttctgtaatacatggtatagaattgacaagaataatctttttttttttttttttttttttttgagatgaagtctagctctattgcccaggctggagtgcaatggcacgatgttggttcactgcaatctcagccttccaggttcaacgatcctcccgcctcagcctcccaagtagctgggattacaagcgtgtaccaccatacctggctaatgtttgtatttttagtagagacgaggtttcactatgttggccaggctggtctcgaactcctgacctcaggtgatccacctaccttagcctcccaaagtgctgggattacaggcttgagccactgtgcccagcctagatttaatcttttttttttcttttttgagatggagttttgctcctgttgcccaggctggagtgcaatggcgcaatcttggcttactgcctcccgggttcaagcgattctcctgcctcagacttccgagtagctggaattacaagcatccaccaccacgcccagctaattttttgtatttttaatacagacggggtttcaacgtgttggccaggctggtgttgaactcctgacctcaggtgattcacccgtcttggcctcccagagtgctgggattacaggagtgagtcaccacgcccggcctagatttaatcattttaaccatgtatgcagttgtaaataatagaactaagaatctggcgctcaggggagaggatgggacttgaagtgtggattatctatttttttctactctgttttatgctgtttttaaaattgtacaagtcaacagtgatacatgtcctatttttagaacttcaaacaatacatacaaaactacagttccctatgaccacgtacttgagtacacaggtgccctcctcctgaatggaatgtatactttttctgcgtttatttacaagtatttgtacccataggaatatatagtgttttagtttgcaaaaataatatcatactgtacatactgatggggtgatcattttgtgatctaccccaccccaactcatgcatgttgttctgcagctttaaagatgttcttgggatctctcaatttcagtcattaataagttacttattttgatacctgcatagtaatctgttctgtggtatgaatatgtgatttaatatatgaatatgccaattgataatatacattatttctaatttttttgatattatacaaatagtgatttttattcttttcaagaatttaaaatgcttggtgaattttagttatgtaaaactagtatgtatatgtacataaattattgaaattactaggatgtttttggcagagcacctcacaattctaccataatgattctctgtaattatctggagagtcattgttcttaaaaatgtttgcagtctgtgctttcattaatcttttctacatgaagttaattttagtttttaaaatatacttaatttttgtagagatttaaaattttttgcaactttgtaattaatgttaatttatatttagaataatttatactgtactattagggcattttcttgcaataaattattagtggagatgagcgactgttgatggagatgagtacctttatcatgcagaatatcagcagccagatattggacttttctcactgccccttaatttacttttttaaatattgtcgttctatggcaatcaggcttttggatattgaggaggaagtaataactacataatgtgataatgatgtctttgaggacccttgtccataacaagccatttgaatcagaataatatcttgtgcaatatggtgttaaggcttttaggttacatctcatttctgaatgtattctggatgacttctattgactttatgatgtttacctttcatatttaaaataagagggttcttttagcagattttggttataaaacatctgaaatagtgtaatttaaataaacaaggtaaaggaaaaaaatatatgtattatgccaagaaaatgagctagtccttatggttgagacgaaattttagctttgagcatttttgtatgtaagcacagaatgaagtaggttggattttatagggttcatctcagtaggaattattgttctatttcatttttgcagaattgagaagccatcataattgttttatatttaaacttttaaacagaaacctaaatttgcataaaaactcaagacagcgtttacagtttcaaggcattttgtttgccttattgtatttgtgtacttcttccatagtgcctggcaaacagtaagtgccaagtacatttagtttgattttattttttattgtatcttatttcttcttttttgaggtagggtcttcctctgttgcccaggctggagtacagtggtgtgatcatagctcactgcagacttgacctcctggttggggagtggtggtgtgcaccagtggtcccagctactcaggaggctgaagcagaaggacccccccagcccgggaggcgctccagaacaccccagcttgggtgacagagtgagaatctttctcaaaaaataaataagtaaataaagttgcttgggacatgttatatagatgctatttaaagctatctggataggtaatatcctccagtttataatcatctgtaccccattgcgtgatggggtgatcattttgtgatccaccccaccccaactcatgcatgctaacagttatgtatgccttttctccaatttatctgcctgcgttttgtcagacgattttcagcgaaccttcactgggcaaaggggaagtcttcttttggcccctgtattactaacaagcattgacttctaaatgggtaatttggtcaggtgtggtggctcacgctgtaatccagcactttgggaagtcagggtgggaggatcacttgagcccaggagtttgaaaccagcctgggcaatatagtgagatcctgtctctaccaaaaattaaaaaaattaggcgagcatggtggcacccacttatagtcttacctactggggactgggtaatatcctcaagggaatgagtgtagatagaatagggaaccaagaactaagatctaggatatgttagcgttaagataatggagaaaaggaatcatcagaggatactgagaaggaacaatctgtgtggtaggacacaaacctggagaatatatcttgggaactgaagggaagaaagtaaaacatggaggaggggatgaacagccatgtcagattttgccaataagttaggtaggataaagactagaattgaaaattgtgtttagtaatgtaaaggcctttgttacatggtcttcagtaataaatagccaggttagcactatttatatatgtttttaatgggaatttttgatgtttacagtgtctcctttgccatgttcaggttttccaacctattggtggtatgtctgacagtggatcacaacttggttcaatgggtagcctcaccatgaaatcacagcttcagatcactggtaagttttagaaacatcggctgctttactttatttttccccgtatgattaaaaaataatcctgagagggccaggcatggtggcccatgcctgtaatcccagcactttgggaggctgaggtgggcgggtcacttgaggccaggagtttgagaccagccaagccaacatggagaatacaaaattagttgggcatggtggtgcacacctgctgtcccagctactccggaggctgaggcgtgagaatcacttgactttgggaggtagaggttgcagtgagctgagtttgcgccactgcaccccagcctgggtgatagggtgagactgtctcaaaaaaaaaaaaaaaaaaaaaaacttaagagaacaaaatatttaatggctgttacatgtcaggtgctcaattaatatttgctgaatgaatgaatgaagatatatagatatgtaatttttattgtagaatattcttggatattttacagtttttttttccttcaacatgggtacctgggtagttgctaattatgtttgtttggtattgtattaacagctttattgagatataattcatatcccctacaggttacccatttatttatttacttataacaatgacacaatcatgcagcctcctgctgtggtgactacagtcgtgcaccaccatgcccagcaaattctgcagttttttgtagagatggggtctcactataatgcccaggctggtttcgaacacctgggcttaaatgatcctcccactagggcctgacaaaaggcagataaataggagaaaaggcgtacatcttattagcatgcatgggtaggggtgggatggatcacagaatgattaccccatcatgcaatggggtacaaaatggttatatactcttcttcataggggaaagggagatggggaagtgtggatgattttagagggatggtaaatgatttttaggggaattcagagggctcgaagaatgtacaatggcctgggacaaagtctgtttggcccacagaatagatagtggtttatgacaaaagtctctccaggtccaggtctgttaaaagacttcagtcagccaggcacggtggctcacacctgtaatcctagcactttgggaggtcgaggtgggcagatcacctgagattaggagtttgagaccagcctggccaacatggtgaaaccccgtctctattaaaaataaaaaaaattagctgtgcgtggcggtgcacacctgtaatcccagctacttgggaggctgaggcaggagaatcacttgaacctaggaggcggaggttgcagtgagccgagatcatgccattgcactccagcctgggcgacagagcgagactccatctcaaaaaaaaaaaaaaaagacttcagtttttatattcctgctatacaagtttagttattgaaaactcagggatgggaacaaaggtaattgtaattgttttcttctttggtggatctggacttaggcagataagagaacttcagaaaacaacttcatgctgtactttgagagaaagaagattgagggaggggagctgcaggggtcagagagaccttgagagacttacttagttcagcaagtcaaagcaccatattttgggatatcagtttctgaaccccaaaagtacattcacagagttcagcaaccatcaccacaatcaactttaaaataatttcgtccttccaaaaagaagccctgtactcattagcagtcactctccatttaacccatccatccacaaacccaggcaactcctgatctttctgtctctagatttgcctattctggatctcgcatataaatggaattgtacagtgtgtggccttttgtgtcttctttgggcagactgttttcaaagttcatccatgttgtagcatgtatcattacttaattcctttttttgctaaataatattttattgtatgagtatacgaaattttaaaaatccattcttcagttgagggatgtttgggttgtttccactttttggattttatgaaaaatgctataaacatttgtgtacaagtttttgtgagaatgtatgttttcagttttcttgggtatatacctaagagtgaaattcctaggttatatggaatccatgtttattagcattttgaggaattccaaattattattattattatttttttttttttttggagacagagttttgctttgttgcctaggttggagtgcagtggtgtgatctcggctcactgcaacctccgcctcccgggttcaagtgattctcatgcctcagtcttctgagtagctgggactaccggcacgcacaaccatgtgtagctaatttttgtatttttagtaaagacggggtttcaccatgttggccaggctggtctcgaactcctgacctcaggtgatccacctgcctcggcctaccaatgtgctgggattacaggcgtgagccactgcacgggcccaaattatttttaaaagcagctgcaccgttttgcattcccactagcaatatatgaggattccgatttctctacattcttgccagtgattatcttttttatgatagccattctagtgggtgtgaagtagtattttactctgtgtgtgtgcgcgcgtgcatatgttttatccatttaatttttttttttttgagaccaggtgacagtctgctctgtcacccaggctggagtgtagtggtgcagtcatggctgactgcaatctctaacttctaggctgaagtgatcgtgccacctcagccttctgagtagctgggactacaggcatgcaccaccctacccagctccctattgtggttttggcttgtactcctttgatggctaatgatattgtcttttcatgtgcttattggtcatttttgtatcttttttggagaaatgtctgttcacgtcctttgtttgctattgtaaattaatacctctgtcgctattgttaattaatatctctgtctttatttcttcctctaatcatttcatgtatcactttcagattaatgtttttaatatgccatccaatatgtttcattcctgctcaaaaaccttaggtacttctcttagactatggtatagagtttctttagtatgagctaagacccttcaccctctgtctacatatggtgtctttgtaggttttttgtttttttttgtttgtttttttgagacagagtctctgtcgcccaggctggagtgcagtggtgcaatcttggctcactgcaacctccgcctcccaggttcaagcagttctctgcctcagcctcccaagtagctggggttataggcgcccgccaccaagcctggctaatttttgcatttttaatagagacgaggtttcaccatcttgaccaggctggccttgaactcctgacctcaggatccacccacctcggcctcccaaagtacagggattacaggcgtgagccaccgcgtccggcctgtaagtctttatatgtgaaccatttgtactagctagaatgagtcactggattttcctcagatgtgtatgtatttctatcacacaatgaaaacctcagtctctctccctttaatttgatagcatttattgattatagaacaattatcatcccctgtattttagtttcaactatgcctggcttatagcttcttctggattatgaataggttaggtcacagatcatatcttagcattattattttcctcaaaacctaaaggtgattgaatataaaaataatactgtcttaaggtaaccacatcatagaattttttcggatttccttcactaactctggtatctttccttagcagtatctgtttcttaaagaaagatattactatttcttagttaaggccagattccagttttttttccccacccctcatcctcaatctagcttgagtagctgacttatatcagaccagaattcttatgacttctttttggcagcttaaagttgaaagcttttattagaacagtcctttaaaacattctgtactttttcagattacataagtaatatacattttattttttactgatttaaaaaaatagtaaattattctcagagacaatgattaatagtttttttctttgcataaagtgtcttacttgctatcatcgttattgaattttttttttttttttactgtgatgataaacactaattgcacctcaaaaagtcgtaatccatagccatctcagatttttttctttttgagatggggtctcaccctgtcgtccaggctggtgtgcagcagcgtgatcatggctcactgcaaccttgatctcctggggtcaggtgagcctcccacctcagcctcctgagtagctggaactacaagtgtgcgccaccacacccggctaatttttgtattttttatagagatggcgttttgctctgttgcccaggctggtctcaaactcctgggctcaggtgatccacccacctcagcctcctaaattgcttgtattagaggtgtgagccacctcactcagccacatctcagatttttaaaatcttgggtctaaaatattctttttctttttttttttgagacagtttccctttcgttgcccaggctggagtgcaatggcgtgatctcggctcaccgcaacctccgcttcccagattcaagcaattctcctgcctcagcctcccagatagctgggattacaggcacccgccactatgcctggctaatttttgtatttttagtaaaaacgggttttcaccatgttggtcaggctggtcttgaactcctgacctcaggtgatccacccgcctctgcctcccaaagtgctgggattacagcgtgagccaccgcgcctggccttaaatattctcttttttataaatttttttctttttctttttttaattcattgcttgctaattgggtctaaatattctgagaatgctcaagtgtagggcaaaaaacaaacacaccatgaataatggataatagttcagcaaacattattagatatgaaacagagaacataagataaaagacagaagtgccaagtttaatagaatcaaatgcccttcataattcattgagttacttctttagttttgatgctagaatgcttagaactaagtattttgcacaaatctccttaatgacatcgtgggttttaatctcttaatgggtcagttatagtatttgttttattgtaagctgcctcaatgcctttctagaatcaagtaaggaataaatatgcaagtgtaaaaaatgaatgtcaggctgggcgtggtggctctcacctgtaatcccagcactttgggaggccgaggtgggcggatcacttgaggttgggagttcgagaccagcctgagcaacatggagaaactctgtctctagtaaaaatacaaaattagccgggcatggtggcacatgcctgtaattccagctactcggggggctgaggcaggagaattgcttgaacccgggaggcggagatggcggtgagctgagatcgtgccattacactccaatctgggcaacaacagtgaaactgtctcaaaaaaataaataaataaaataaaaataaacaaatgtcaccatgtattgtaatggcaagaagggataactggtcaggaaaaagagatcagtatttgactagagtcactgggaaagaaggtggtgtttggattgctgctatttatttatttattttaagggacagggttggccgggcatggtggctcatgcctgtaatcccagcactttgggaggctgaggcgggcagatcatccgaggtcaggagttcaggatagcctggccaacatggtgaaaccctgtttctactaaaaaatacaaaaattagccaggtgtggtcatacgtgcctgtaatcccagctactcgggaggctgaggcaggagaatcacttgaacctgggagacagaggttgcagtaagccaagatcgcacccctacactccagtggcacagtcacggttcactgcagccttaacctcctgggctgaagcaatcctctctcctcatcctctatagtggctgggactacaggcgtgtaccacccaccacacttgactaattaaaaaaaattgtgtttttgttttttttttaagacggagtctcgctctgttgccaggctggagtgtggtggcgtgatcttggctcactgcaacctctgactccctggttcaagcaatttttctgcgtcagcctcctgagtagctgggattacagacatgcgccaccaagcccagctgatttttgtatttttagtagagatggaattttatcatgttggccaagatggtcttgatctcctgaccttgtgatctgcccacctcagcctcccaaagtgctggaattataggcgtgagccactgcgcccggccaaaaatttttttttgtagaaacaaggtcttgctatgttgcccaggatggtcttgaactcctggcctcaagtgatgctcccagcctttccataagtgttggaattataggcctgagccactttccctgacctaggattgctgctgtttaaatgcagaaaagtagaaaaggaccctttgaggagacagcatgagcaagacacatgaaagaagagagtacacaaaacttgccctaatacccatgaaagctcctataataggggagccctgagaatgggaatggctgtgtctttcaggtgtgccttaaaaaaaatttattgctaagggagatggagatgggaagtaatcagtgtttgtatcaaagggtggttagatttgtgttttagaaagttagaaagagaaaaaaatttttctttttttttttttttttttgagacagtttcgttctgtcgcccaggctggagtgcagtggcgcgatctcagttgactgcaatctctgcctaccatgcccacccccttacctacttatttatttatttattgaaacagagtctcgctctgtcacccaggctggagtgcagtgacttgatcttggctcactgcaacctccgcctcccaggttcaagcaattctcatgcctcagcctccccagtagctggtattgcaggcatgcaccactgtgcctggctcactttttgtatttttagtagagatgaggctttaccatgttgtccaggctggtctcaaaatcctgacctcaagtgattcacccacctcggcctcccaaagttctcgaattacaggcgtgagccattgttcccagccaatttttaaattttttataaagacacattctcattgtgttgcccaggctggtcttggatgttttgaatcagctcttcgtttcttcttatcatttagccagggtctttaccttggatgtaagtctgttttcttatgtccttccctgtctttatttacctgtttcccatttaattatgcctatatataacctcagctattatactgaactcatctgtgtcttctttttttcttttttttgaccgggaaatttttttttaaattacaagctcaacccatttgttctgtttcaaaggtgcagtacttttcttcatttattagtgaaagaagttaagaaattaactttccaaaaaaatcagcaaatggcaagcaaatgtccttgaaagtcacagtcacatatagtgtctcctagaaaagaggaggggtaagacagcttccacctactttcacaagtttcatcaaatactggatctactcaagggtggagtaaaaaggcaactaactttctaaaaggagtatgttattaaatgaggcatttactatactccttcctaaaagccccagatggggaacatgttttctcaactagacctaggaagtagactgtggaatcaatcggtcctcctcaccttaagggccatccactggttaatgaattaaaaaaaaaaaaaagactgaaaaacaaacctcccccctaaaaaagaggagggggaaaaaaaaccactaagatgtcccagagtggaatcagggagcagcttcaacaattccaattagtctgttacagagtcatccacaagcatgccttgctttaaaaatacatatatatatcttgaaataacaaaactgaaactagtactaatcacttttctgacaatatacaattactcaaaattaactagtactgggctagggatacgggggggcggcgcatagctatgggccttgtctcacatgagtacatgtgggtaggtgcagtgcgtttgtcattatggcaaaaacgaattttaatttttaagctttagtttgacttaaacattgcttttagtatgatgccaacaccagctatgcagaaagggctctggagagatgttcctagcagcacacatatgcagctcttcttcggttctggaggttccagggcagccaatattgcttcgtcaaatacattctttaggcctttctttgtgagtgcagaacactccacgtacttgacagtcttcaggtcatgggccagcttattcagcagtctctggagtgataggcttctgtttgttcttggcaagtttctcaatagtagaggggtcatctttgagatcaatttgggtcccaacaagcaacaaaggagtctttggacagtggcacccacttttctttcacattttcaaatgaaaatggagagatggagagaccactgaaaaatagactagaaatacatctgtttgtggataactcagcagtcataatccctcataatcctcttgctctgcagtatcaaaaagtccaagagtatatggttctctaccagtcataattgttattgcatagttgtcaaaaacagttggtacatattctgatggaaatttgttgtgttgttttaccaacagcaccatcacccacaacaacacacttaattgtctgcattgctgaaatagttttgtatccactttaaatatttcaaatctcatgttgacctcagcttctccaccgggttgttggctcatctgtgttttttatttgatgtttgttgtatgctagcattgggcaaaataaggaaactttggtatttgccagaaatttcttatattctcgtctttactccaaattaagaaagagatgtcatcttgattttagttattattaatcgtaattaaatattactgcatttcccaaatttattacagtgcaatatatttagctctgattgttcagggaccaaaaagatcccttatacttatgttttttttttattcctttaacagtccagcaaactaagaattttatacttgtgatttagagtttagttctccacaggcagggcagagttcttccaaagaggtagctgttgctcaactggattgatctcttacctggttcattattctgcttatttatttagttttggcactgttttttgttgtaccttgttctctgtagcttatccaaagtaggttggataagctacggatccattctttttttgtatgtgtattgtaaaatgtttatgttgtatcagagagatacactgaagaactgaaatcagttcaaagcactgaccttcagaacagaaggatcagaggaacattagtttaagccatgaaaactatttgcattagtatgtgggtatgtgtgagagagagagagcacatgcatgggagagtgagatagccagcaagtgattataataaagcagagagacagagactagaaagcagggaaacttttgttttctaccatgactaataacaatttggttcaacatgtatattaaatacctctcagattaaatcccagagtgctccagaaattgtaaagattggctatatctgtgcaatcaagaggctcacggggtgagttaaatgagtaaaaactagtaagacaaaatgaaaagctgacggagccatacgtaaatatggaaatactctggaagcatggaggtggaaataatttaacttcttaggattaaagaagcctttaatcaaagagaagggggatgtttatctctcaggaaatataattttaatgggtataaaagaaaaaaggatcattctcagtagagggagcagcatgtttagaggaatgaaagtacatggcccatgtgaggaacagcaaataactaagggtggctagaatatagaactttggtaagatttgttttagtaggaggctggaagggtaagttatagctgcatactaagcaaggtaaaatgccccataagagtttaaacttcatttttcaggcaataaagaatcatttaagtaatgacattaatgacatgatcacatctattctaggaaaataattctggtggctgtgaggggttggattggagaagtgagagtaaaaacagttgtttagaggcctctcatagtagcccaggtgtcagatgagactgacatttttctggtcctttttcttccggtttataatgtatagttttttatttttttgtttaatttactgtgggactttagttttcagaaagtagtacattgatttattttatatttgtaatattatgactataacacaaggttttgttcaatctagactttgagatttgaatactgaaataatttctcctgtccaggttttgcagtgtgacccttgggcaaatttttaaatttcacagagcttctgtctttttttttttttttttttttgagatggagtttcacccttgtcacccaggctggagtgcaatggcatgatctcagctcactacaacctctgcctcccgggttgcagtgattctcctgcctcagcctcctgagtagctgggattacaggcgcctgccaccatgtctggctaatttttgtatttttagtagagacagggtttcaccatgtttgtcaagctggctcctgacccccgttgatccttttgactgagacttccaaagtgctgggattacaggtgtgagccaccacgttcggccgcttctctttttatgtgtaaaaattaggacagtaatacctgtttcgcagaataggtattgatattgaaatgacatttacgtgcaggcacatggtaaatactaaaattggtgctcctccacccccatgtaaagtttgttaggccaggcctggtggctcatgcctgtaattccaccactttggtaggcctaggtaagtggatctcttgagcccaggagtacaagaccaacttgggcaacatgtcaaaagcttgtctctaccagaaaaaaaatacaaaaatttcctggatgtggtggcacgcacctgtagtcccagccacttgggaggctgagatgggaggatggcttgagcccaggaggtagaggtggttgcagtgacctgagattgtgccactattctccagcctgggtgacagaaccagaccctgtctcaaaaaaaaaaaaaaaaaaaaaaaggtttcagtggggtttggtaggattatgtagcaaaattgctttcacaaatttgaatccagctgggcacagtggctcacgcctgtaattccaacactttgaggggccgaggcaagtggatcacctgaggtcaggagtttgacaccagcctgaccaacatggtgaaaccccgtttctactaaaaatacaaacattagctgggtgtggcggcgcgtgcctataaccccagctgcttgggaggctgaggcaggagaatcgcttgaacccggcaggcggaggttgcaatgagctaagattgtgccattgcactctagcctgggcaacaagagcgaaactcctatctcaaaaaaaaaaaaaagtttgaatcctagaaagccccaacaggggcagatcatttccttcctgtcagccttgcgttgctctttgttctaggtttaatcagtttcagagtgccacaagaggccctgaaatataatgagtgtatgtataattgtttgggctatttcaccttttcttagaccagaaatgtattaaaagtagaaattttatgtttttctgtgtaatcctgtgattaaatttggctctatattaagcactagagctttgatttaatagtactttttttttattttttattttttaatagagatgaggtctcactgtgttgtccaggctggtcttaaactcctgggctcaagtgatcctcccgcctgggtctcccaaagtgctggtattacgtgcccggcctattacattttaatcagagatagctctggtccccacttgaatattttttattctgaaaaagactttctatttcatgtttccacttagatgtctcagcatctggcatctgaaacaatttttttttttttttaaaagacagttttgctctgttgcccaggctggattgcagtggtgcaatcacagctcactgcagccttgacctcccaggcttaagcgatcctcctgcctcagcctccccccagcagctgggactacaggtgcacgccatcatgcctggctaatttttaaaattatcttttgtagagacgggggtctcactatgttgaccaggctttgttcaaactcctgggcctcaagtgatcttcctgcctcagcctcccaaagtgctgggattacaagtgtgaaccaccatgcttgatcttgtctatttgtctagccttctcttgcaactcttctttttcttcagtcagtcattctgtggctagcttgaatgccagcaaaaaggcacataagcctaaaaggatggaagtatttgatatatgtaaagtcagagtttcagggccaccacctgggactatgcctgcttagatatccagactttggactatatattaagctgctgcttcttttttttttttttttcgagatggagtcttgctctgtcacccaggctggagtgcagtggcgcaatcgcggctcactgcaatctccgcctcccaggttcacaccattctcctgcctcagcctcccgagtagctgggactacaggcgctcgccaccacgcccggctaattttttgtatttttagtagagacagggtttcaccatgttagccaggatggtctcgatctcctgacctcgtgatccgcccgtctcagtctcccaaagtgctgggattacaggcgtgagccaccgcacccggctatattaagcttcttaagtagttactatataaactcctctgacaactccaagggttccttaactttgatgagcattagcattctctgaactttgctgctacagtagataacctgggtggtggagtagataacctgggtggtgggtacttccttggttgtagttacctcatctatgagggagcaatgacttgccacctatggaaatcatggggtgctttgctagatttctacttgttataccctgtaaggggcctggacaaagctattttatggcaaaggtaactaaaaggtgaaggctaaggagtttgtatctcaagatgcacaacataggaagctcttccttagataatatgagatgttaaaaaaaaaatcttagtttgtagttcttattcttccattggctttccaacacacagaataaaatctaaattatcattattattattatttttgatacgtaggctcactctgtcgcccaggctggagtgcagtggcataatctcggctcactgcaacctccacctcccgggttcaagcaattctcctgcctcagcctcctgagtagctgggattacaggcgcctgccaccacacctggctaagttttgaaattttttagtagagacgaggtttcgccatgttggccaggctggtcttaaactcatgacctcaggtgatccacccgcctcagtctcccaaagtgctgggattacagatgtgagccgctgcgcccagctgcagattctttatcttggtttataaagctcccatacaaagcttatctcccttcatttaccattccttcctgtgcttgctatactttccctcagatatgccatactcatttgcctctctctggaatgctgtcttattcccacctccagtcttcccatggctggctccttgtcatttggatggttgcttaaaagtcttctcaaaggccttccttactaccaagtcattttctgtcacatcagcctgtttttcatcataaatactttaattagaatataatctccttgaaagccagatccttttctttactgttaattgctttagggacagagtttagagcagtatctgacacatggtaggcattcagatgtttgttgaccatgtttgtcaatgcatacattttgttttgagatatggtctcgctgtgctgcccaggcaggtcttaaacacctaggctcaagcagtcctcctgcctcagccacctgagtagctgagattacgggtgcaagccaccctgcccagccatatgtgtactttttaaatttttcctcctgttgcccaagctgttgcacaaccatagctcactgaagccttgacctcctggactcaagcgattctcctacctcagcctcccaggtagctgggactggcacacgccactgtgcccagctaatttttttgatttttaggcgagatgaggtctcgctatgttttccagattggtcttcgactactgagcttaggcaatcctcttgcctcagcctcccaaagttctgggattagaggtgtaacccgctgcacctggcccatatgtgtactttttaattgatctgagttctggacttttgataccatggaattctactgatgggaatttgggttgatggtacggggaacctctatatttatttactaggatgggaggaagtacaaaggttatgagtgaataaaattggtaagtattttagagcaaaactgcttctctgagtaaatttagtaaatctgcctaattatgaagttaaattgatttcatgagtgaattaacatctcaactattgaaatgtttttcatttcttttacatagtcatctcagcaaaacttaaggaaaataagaagaattggtttggaccaagtccttacgtagaggtcacagtagatggacagtcaaagaagacagaaaaatgcaacaacacaaacagtcccaagtggaagcaaccccttacagtgtaagcttggaagtatttttctgtagtatgttttgtttagtagatgattggaaatacaatttaaaaaaatgtttctcactttggttttttgttgttgttgttcctcctttctctcttctttttttttttttctttttcctaggactccttctggtttgcttttttgtttctctttagatagctgtttttatagtcactccctttctttaccttctctagtttagttggtgatgatattgctcttgtcactgaacaatagctgaagagagcccatggtcacggacctaaaaagatttctggcagcactttttattaactttgggttgaattaagggattatgagtactccccccccccccggtttttaacttaatttttaaaaatagtgttttagttagttttttctttgttttattttgagatagagcctcaccctgtcacccaagctggagtatagtggcactatcatagctcacagcagccttgaactcctggcctcaagagatcctcctgcctcagcctcccaagtagctgggaccacaggcatgcatcactgtgcctggccagttttttagtattttaaattacggtgccagttatactatagttatttattttttgaatgagatggggtcttgctatgttgtccagagtgctctctctcaaccttcccggctcaagcagtcttcccatctcagcctttttctcaagtagctaggactactactatacattttattctacaactttctttttgtacttaacactaatatcatggtgatctctttacctgagtacatatggatcttgcatcccttatatagctttgtaatattccttaatatgggtggactatattttaatagttctgtattgattctaatgttgcgctattaggcagtattgcagatacatccatgtgcatatatctttgtatgttggtgtttatatctgtagtgtagattcatagaagtaggatatagctcagttttaacacaaagccctaaatgttggcattataatctaagatattgacagccattgaaggttaattttaatttttaaaattaaaatagaagaaaacacatggagccaggtgtggtggctcacacctgtaatctcaactctttgggagactgagccaggaggattgtgtgaggccaggagttcaaaggtgcagtttgatatgattgctcctgtgaattgctactgaactctagcctgggcaatgtagcgagaccctgtctctacaaaaagacaaacaaaaaaaaaaaagaagaaaaagaatgatttggccaggcatggtggctcactcctgtaatcccagcagtttgggaggccaaggtaggaggatcacctgaggtcaggagttcgagaccagcctgaccaacgtggtgaaaccccatctctactaaaaatacaaaaattagctgggtgtggtggtgggtgcctgtaatcccagctactcgggaggctgagacaggagaattggttgaacctggtaggcggaggttgcaggttgcagtgaactgagatcgtgccattgcgttccagccagggtgacaagtgaaactctgtctcaaaaaagagagaaaaaaaaaaaagaatttatggaagatcatcttgaggcccgtatcattcggatgttcctcatctgtgtttatttcaacataaatgtttcttaggctttctgtttttaattaatggctcattgtagattgagtcaaaatgaaacaatgtattaaaaaaatttcaagaaaacacatgaggctgggaatgactgcacatgtttgcaatcccagctacttgggaggataaggggggaggataaggtgctttagcccaggaggagttcgagattaaccagggcaaagtagcgagttcccatctcatatatattttttcctttaccaagtggtatctataaaaggtcgcagcctccatgattaccagagatgttcagttgaattagatggtcacctaatttcctccaactgctttgagtgcgtacttgatatgcacttggaggctcttaagctgttaatgtcatgaacttcttagtgatttaaaagttaagaaaaaaactctctttgtagttctatgtggtagtgctgttcttgattacaaacatttgggaaacttacaattcaagttattttcctgaatttttaagttgcagcaaattggcctggaattttatcacttcccattgtcgtgtagcaggctttccagactgcttttgagaattgaattgaaacaagactgatcatctttgacagtatactttatgtacctttcttccatattaaaaatagtaaagttaaatttatttgccttttatttcatccctattatgatttctaaattgactaatagagaatttcttttttccactctcacccaggctggagtgcagtggcgcgatctctgctcactgcaacctccacctcccgggttcaagcaagtctcatgcctcagcctcctgagtagctgggattacaggcatgcaccaccactctcaactaatttttttgtaattttagtagagacggggtttcaccatgttggccaggctggtctcaagctcctgacctcaaataatcctcccacctcggcctcccaaagtgctgggattacaggcgtgagccattgcgcctggccgagaaatattttcctaatacaatatataatatgagctctcttgaaagtagcatctgagaattttgaaaagaatgaatacattgtatcccctaagaagaggagcagtgtggaatttttagtttgttttatctacccattgccgttgaaatggtgctggttaataggtacaggtagacttcaaaggaggaaagtgtttctttgtcccctcaaacttgatcacattagagagaatgagatatagagaaattcaaacatttctggaatttgtctttatatcattgaaccataggactgtggtagattatatagtgctcctagctttctgatccttgactctaacattgattctacgtgtattgcaaattcaaatttcccagtttactttggaaataccattatagagagtattccttattggcatttagcaaggaatgagtgagtctatatttgatagttggactgggcaacttgcctctagcagtgtgaaacttgatgtatgtaatgtaatcttcaaatcatgtagctgacgtgaggaactttttaatataaagtttaatgtcaggattttattcacattacagttctgctacttactggctatttgaccttaggcaatttgctttatctctgaatgtcagtttctgtatctgaagaaggaagtgataattcccatctcatagggttactataaagataaaataacttcaagctctgtaaactactgacataaggatttaatttgtaaagttactcttctgtactactaaagtaaaactagttttccaatagtttgttgcaggataagcagttttacttttgttgacaatatgtgtatgaatttacttctgtagttcaactgcaagtgaaaatgaccatgtaagcatgtagcattcagataattttcataagattactgaacataggccaatattgattgtatagtaaactgtaaggggtgcagtgagaagactttagactttaaaactgaattgtaatttatttaggatctcattgtgatattcaataaaaataatattttttccctcttttttcacttttagtatcgttacccctgtgagtaaattacattttcgtgtgtggagtcaccagacactgaaatctgatgttttgttgggaactgctgcattagatatttatgaaacattaaagtcaaacaatatgaaacgtatgtatgtaagactaatagaaattgcacttagctgtttgtttttctggaagaaatttatatgtcaaacatgcataatgactcatgttctctcatacttttaagttttacttggttataggatgaacagatagaagaattttacactattgaaagtattctgagtaaccttggtttgaccattcattttggattcagtatttttagtaaatatttatttacttagtaaatagatattagtaaagtaatacatatttaattgtggaaaaactaaaatatagagcagagatgaaagaaaaaaataaaaatcccacttcagagacaaatcaaatgaatatttttacagatttccttttcagatgcttttttttttgggagggacatggggagacaaggactcactctgttttccaggctggagtacagtggctatttacaggtgcagttgcagcacagtgtagttttgaactcctggcctcaagtgattatcctgcctcagcctcctgatatatctgggactataggcaggtaccaccacatccagctttaaatgcttatttttaaaaatgtcctcattttatgaggttgtggttttatttgtatatgtatatttatataatgtagaaatatgtgtagcttgttttaattaatatatcattttaaaacacatttttttctacccctcgactatctaaaacatacttctaaaaattttctcatttaggacttattagatataatttatccttaaattatgtttttactcaatttaattcaggtatatattactaaataatccttattcttatgctagcccattttatactatagtcttacaaggatggaatgaacataataaacgatggagatactattttacatcatgaatatgaaacattagcatattttgtcctttttaaaagatacagtgttttggtgtcaaaagtgttcaaaccttgggtgaaacatagttaaacagtttatatgcacatatagttatattttctcggacatcacatttttaacagttaatttttaacagttaagatgccttaactgggaaaaaagtgaccattttttctgtaactttattttcttccagttgaagaagtagttgtgactttgcagcttggaggtgacaaagagccaacagagacaataggagacttgtcaatttgtcttgatgggctacagttagagtctgaagttgttaccaatggtgaaactacatgttcagaaagtaagtgactacctttttaaggtctttaatgattcttcttaaataaaatagccattgtagtatgctgtatgtaattattttgattttttttttcagattaataaaatgtttttttctggccggtgtggtggctcacgcctctaatcccagcactttgggaggctgaggcagaaagattgcttgagcttggaggttgaggctgctctgagccgtaatcacatcactgcggtccagcctaggtgacagagtgagaccttgtttctttaaaaaaaaaaaaaaagaaatgatttttttctttttaaaaaatagacattgatcactttaaacattttctttttagtgtattatttctgtgaataaaagcatgtatatttttacataagttgaaaaattagccaaatagaagttgaatcacatttgcctccatgagtaatgagttgatttatatagtatttattctgtaggccaactatggcagttaatatgggttagatgccacaccgccaactgtgccaatggcagacagagtttattgtctgtagcagtgtggggctgagtttaaatatgactttaaatccttttttttttttttttttttttttttaagacggagttttgctcttgttatccaggctggagtgcaatggcacgatttcggctcaccgcaacctctgcctcctgggttcaagcgattttcctgtctcagtctcctaagtagctgggattacaggcatgcgccaccacgcccagctaattttgtggggtttttttgtttgttttagtagagatggggtttttccatgttggtcaggctagtctcgaactcttgacctcaggtgatccgcccacctcagccttccaaagtgctgggattacaggcgtgagccactgcatccggcctctaaatccttcttaacactgtaccacccagccattacaagctgagatccatttaccattccccttctacttctgtaggctacacttacagagatatcttttgacaatactaattcattatatgtgtgttagtaaatcttacaatctctgatttactagtgtgtgttaaaggaaaataaactgtggtggcacctgagttagtggctacacagctagcatatttaatagaactttttcctactgttttcccatcagatatttccatcacttcctaatgtgttaagtgtattttcacttgaaacatagattttagaggcctgaagacaatgaaagagcagattaatggatttcttgatgagtttgacgaagatcttttggtttacttaggaactgcattatgaaacattttgcagctgtcaggtgctattctttttctactttgttgaaagacttcctacttcctctttgactcatgacttttaaaaatagcaggacaggctgggcacagtggctcacaccccttgatcccagcactttgggaggctgaggcaggagggttacttgagcccaggagttcgagaccagcctaggcaacataacaaaaccccatctttgcaaaaaataaaaaaatttgccatgtgtgtggcacgtgcctgtagtccaggtacttgggaggctgaggtgggaggatcacttgagcccaggagtcagaggttgcagtgagcgaagatcacaccactgcacttccagcctgggtgacagagtgagactctctctcaaaaaaaataaagtagcaggacctaatatgtcttccagattagttctctggggctagtgaggatggaaagaaatttctgaaatggttatactgatttggagttgacactttgattattgttcacaagaactctataatagtcacatttttctatacataaattggaagtctggaagataaaatacaagttacattgttaaactgccctaaacctcagtatttatagtgtcctaagcttcgcccatagaagatgaaactattactaatgtaaaatatttaataattgctggacgcggtggctcacgcctgtaatcccagcactttgggaggccgaggtgggctgatcacgaggtcaggagtttgagaccagcctggccaacatggtgaaaccccgtctctactaaaaatataaaaattagcctggcctggtggcgagcacccgtaagcccagctgctcgagaggctgaggcaggagaatctcttgaaaccagaaggtggaggttgcagtgagccaagatagtgccactgcactctatcctgggtgacagagcgagactctggccaggcgtggtggctcacgcctgtaatcccagcactctgggaggccgaggcaggcggatcacctaaggttgggagtttgagaccagcctgaccaacatggagaaacctcgtctctactaaaaatacaaaattagctgggcgtggtggcgcatgcctgtaatcccagctactcgggaggctgaggcaggagaatcacttgaacccgggagttagaggttgtggtaagctgagatcatgccattgcactccagcctgggcaacaagagcgaaactgggtctcaaaagaaagaaaagaaaacagttataacaatatactacaataaaagttttatgaatgtcatctctcagtttcactttcactccaaaaatacctcatttttttagctttgtttggacctttggggggaaaaataccttattgtactcacctacttttggaccacagttgactgtgggtaattaaaaccatagctaaggggaggcctactgtacttacagacacatttttggttctttctttttggtggataaattttctaaaaatggcagttatataaataaactttttccaagtgaaacaaagtgtacttgttttttctttttctttaagttgtattttaaaactagctggctttatattcccctactttcaactagtttaatatctcgctacaagtctcggttataatgttttctttacataatttgttatggtgttttccttcaatgaagtacagagttaatctgctttcatgagtctctaggaagaggtcttcctagacctcttcctagctttttttttttttttgagacggagtcttgctcttgtcacccaggctggagtgcagtggcactatctcagctcactgcaacctctgcctcctgggttcaagcgattctcctgcctcagcctccagagtagctaggattacaggcatctgccaccacacctggctaattttaatttgctatttaggtagacttttttttttttttagatggggtttcgctctgtttgcccaggctggagtgcaatagtgcgatctcggctcactgcaacctctgcctcccgggtttaagtgattctcctatctcagcctcccgagtagctgggtttacaggtatgcaccaccacgcctggctaattttgtattttttagtagagacagggtttctccgtgttggccaggctggctttgaactcccgacctcaggtgatccgcctgcctcgacctcccaaagttgctgggattacaggcgtgagccactgcgcccggctgacttttttttttttttttgagacggagtatcgctcttgttgcccaggctggagtgcaatggcacgatctcggctcactacaacctctgcctcccgggttcaagcagttctccttcctcagcctcccgagtagctgggatgacaggcatgcgccaccatgcttggctaagttttgtatttttagtacagatggggttttaccaagttggccagggtggtgtcgaactccggacctcagttgatccgcctgcctaggcctcccaaagtgctgggattataggcatgagccactgcgcctggcccagctttttttttttttttttttttttaaaggttgacttattcttatagcccacagatctgaagtaacaaatcaggtgtgggcagttcatatctgccagaggttctcattcatctttttttttcttttcgtgggatggtttttttggtgagttgtttagtaccagtcttcccatttatgacctctaacaagaaacacagaaaagtattattgccaaagactaatactagttttcctaaagagaaagaaaaatgcattttactttcaactttttttttttttttttgagacagggtatcgttcatttgccaagggtggagtgcaatggtgtcatcttggctcactgcaacctccgcctcctgggctcaagtgatccttccacctcagcctccccagtagctaggactacaggcgcactcagccacacccagctaatttttgtattttttgtagacaggttctcactctgttgcccagggtggtctcaaactcctgagctcaggcaatcctcctgcttcggcctgccaaagtgctgggtttataggcacgaaccaccactcccggccacttttaacttcctgattataaaataggaacatagtcttgtagagatctttactttttatcatgtatactctggatgtgtttaaaattaatttagggagagtttttggaatatgtgacttctggttcttattctatgcattccattccttttaaattttgatgctttgttatgttaggctctagtttttgtagttccgcttaacgttagggtaaaccattttcatatgtgaatatattgataatgtttcttactagaataataaattctaagaaagtagcctaaattttttgctttaccaaatattatttgaagttactagatctcaactggtctgggtaccaactaattttatagagataaactttgctgtaatgttagttttaaaaatttgacttacatttgaacatacgtctatgtatgctcagaatattaaataatttacttccccacaaaaggtagtaaaactcctttctttctttttctttttttcctttttttttttttttttttgtgagacggggtttcgctcttattgcccagactggagtgcaatggcgcgatctcggcttaccgcaacctccatctcctgggttcaagcaattctcctgcctcagcctcccaagtagctgggattacaggcaagcgccaccacgcccgactaattttgtatttttagtacaggtgaagtttctccatgttggtcaggctggtctcaaattcccagcctcaggtggtccatgtgccttggcctcccaaaaagtgctgggattacaggcatgagccaccgcgcccagctgtaaaactcctttcaacatgtatgttatgtttttgtcttactttatgagaggtactgtaaaaattgaagtattgaggctatgatatggtcattgtgaatttcagtgaagactactgtgttcttcatttttacaatttacaaagcccgttgttatatattctcatatttaatatgtgtaagatataaaataaaatgagcatccctgaaactatcacacagcttaagaattagagtattaacaatatcattgcatccacctgtatttttcttcctatattattcctttcctttcctttcgagataatcactattctgaactttgaatttgtcatttctgtggtctttaaaagttttatcctatgtgtgatatataagcattacttgtacgtttctcttgagctctatgaaaatatcagtgttgccttttttttttttttgagacggagtcttccactgttgccccggcttgagtgcagtggcacgatcttggctcactgcaacctccttccgggttcaggcaattctcctgcctcagcctcccgagtagttgggattacaggcgtccacgaccacactcagctaattttcagtgttgcctttttctttttttgagacggagtctcactctgtcgcccaggctggagggcagtggtactatctccgctcgctgcaagctccgccttgccggttcacgccattctcctgccttagcctcccgagtagctgggactacaggccttttaagatttagtcatataattgtgtccgtaggccattcacttttactgctgcatagtaatctgttgagtgaatgtaccgggttttaagatttttatatcaaaggacatttgcttagctttttttttttaaaccatgtgaacagtgatacattgaacatttttgcatatgtttattaataaacagatttaacgtttatgttgggtgtatgcttgagagtagaattgctggggtatgtttattttcagctttacaatattaattgcttcttcaaatatgctattaggatatttaaaactgagatgaaatttacataacatacaattaacggttatataaagtgtacaccttaatggtgtttagtgtattcacagtgatacacatccaccatctgtctctagtttcagatctttcttgtcaccttagaaaaaaaaccccatttctttcttctcccaagccgtgataactgctaatctgctctctgtctctatggatttgcctattcaggatatatcacataaaaggaatcatgtgactttttttgtttggattctttacttagcataatgaatttgaggttcatccaagttgtagaatgtgtcagtacttcctttcttcttatggctgtatgatagttctactgtgtatatttgtgccacaatttgtttatccattcattcattgatagacatttggcttatttccatttggctgttatgaattataaataatgctgctttaagcatttgtgtacaaggttctgtgtagaaatatgttttcatttcttttggatatatacctaggagtagaattgctgatgcttgtttttgatagtttctcatttcttccttgtaattttttttgatacataggaattttttttaaaacattctccatttgataattccagtgtctgaaatccttgggtatataaatggttttttgtctcttcctcattgaggtttgttttcatttgcgtttgttcttcgattgcaagtttatatttgatcttaatctgttggaatcttaagggcctaaattggggattctttgccccagagaacatttcttttgcttctgctagttgctagggtgtaccactgaactgggaacgcttcaactcctttcctacctgtgtatttgtaaaatggatcagacccttgccagcctaatgtggcaggctctggttcagcaccacaggtttgctgctggcccaaggctttctaatccatctgaggattgaaaatggccctctggataacccagtttttcacatttgctcactgcatacttgtgtctgttcactttgtttttttatttttgagacaggatctcgctgtgttgccagactagagctcagtggctattcacaggaacggtcatagcacactgcacctttgaactcctggcctcaagcagtcctcctgcctcagctttttgagtagctgggacttcaggtgctcaccaccatacctggcttcagttcacttttttgtttttgagattgctagacacccaagaaataggaacgatgtgttaaaacgctttatctaggagctagttattttgtggtgggagggcaggtcattttgacgagcttactgagtagaagagatctttgtagatcttccaaagtttcttgtgggtaaaacatgtgcatttagcaatctgacaaattttcttgaggaaatttggattgggaatacctttaaagggcaatacgtttgtaaaatgcagtggttaagaacaaccattgttctcttcttggacgttcattgtataagtgttagatttttgttgttgttgttgttgttgttgttaactattctctggttgtaagcagaggataagatctaaataatttatgccatacatttcatagttatggcttcactttatattggagtgaaataaaagagtgaatattccaggcatggtggctcacacctgtaatcccagcactctgggaagccaaggcgggaggatcacttgagtccgggagtttgagaccagcatggacaacatggtgagactccatgtattcaaaaaaatctttaaaaaatgtagctgattttgtggtggcatgcatccatgcatcctcccactttgggaggctgaggtgggaggattgcttgagcctgagaagttgaggctgcagtgagctatgaccatgccactgtactccagcctggacaatgcatcaagaccctttgtcaagaaaaaatatgtatattgaaaaatggcccttgtttagactttcctaatgagatgtaaattttgagaaataatagttattatttatggactgcttatatgtgctagcactgtgctaaatgtttacatgtttaattcttataaatactctatgaagtaggtgtcatccccattttatatatgcaggaaaagtacaggaagtcaagtgtacttttgtaaggtcacaaagtacatgataaagctaggatacaaacctaggcagtctgccctcagaactcatgtgattaaaatactgttctttgtcactgtagtgagaaggttttagaagtagcaaataatggtagacttaaatggattattcctaatgattttcttaattttgagaaaagtgaaatactaatagacacattttagtaacttatgctggatattttgttgtggttttctgatttcatttatgtcccattcataagccattttaggggactatattccatattaaaacattcttaaactgaaatttaccctttatagccaaaatgtatttcattgtaccattttttttttaccacattaacatctttattgagttgtattttatacaacataaaatttacccatttcaagtgtacagcttaatgaattttagtaacttaagtgagggattcaactatcactgtaatttaggtttaaaacatttttatcccctcagtaaaatccctcttgcctgtttacaggagcttcccttctcactgtcagccacaggcaaccaccactaatctgtatttttttttttttgagacggagtttcactctgtcgcccagggtggagtgcagtggtgtgatctctgctcactgcaacctctgcctcccaggttcaagtgattctcttgcctcagactcctgagtggttgggactacaggcgcccgccaccacactcagctaatttttgtatttttagtagagatgaagtttcgccatgttggccaggctggtctcaagttcctgacctcaggcaatctgcccaccttggcctcccaaagtgctgggattacaggtgtgagccaccacgcccggcctctattttttatctctaaaaattcgtctttttctggacatttgtataaatggaatcataaaatatctgttttttgtgtctggcttctttcacttagcataatgtttttgaggttcatccatgatatagcgtgtttcattagtttgttctcttttattaccaaatagtaataattccattgtatagacaacattttattcacatactatttaaagataatatatttctagactggatgagacatttaccaactttgctaagtatggtatagtatagtggtgactcagtattttttaaattaatccaccaattatgcttttttgtaatatggtaataatttccctgtttaaactatgattctatccagggcctattgttcctttactaaatggacctaggtggtcgaacttgagttcttgtttctacatgtgatcatttttctttctctttccctgtttaccatttgttttgcttctttaaatgtacctacctttagcaccctccctccaacacttttcttttttttgagacgggagttttgctcttgttgcccagactggagtgcaatggcgcgatcttggctcactgaaatttctgcctcccgggttctagcgattctcctgcctcagcctcccaagtagctgggattgcaggtgcctgccaccactcttggctaatttttgtatttttagtagagacaggttttaccatgtaggccaggctggtcttgaactcctgacctgaggtgattcgcccaccttggcctcccaaaatgctgggattacaggtgtaagctgttgcacctggctcctccaacactgttacagtaaaaagatctggactgaatcctaaggatattttccatcaataaagcaagaagaaaataagaatattgtggcattaatttttggcaacttggattcccatttgtggctttcctaatttttaagctgttttccaggcccctgcaataagagagacgttatgggtttttctgtttctggaatcgattttattctgctggcgatcagcacttttttatgaggtatttgggatacaaagatggttaaaacactaggtttaaattagagttagacatatttcaaaaaaaaggcaggaatagtagtgcatgagtaatatacctttagtaattaacatcccgtatccattaattattaagcatttgcacaaaattttggcagactttttttgcagtcatgaaaatcacatttttccttttaaagtcatgttggaatttaagttatagtatgttctttattacaaagatttaataaaaggctttgcttacatggcatgtttagaaaagaaaaaacatgaaaactactctcttgaaactcattttctgtttaaactttgatgttaaaggtgcttctcagaatgatgatggctccagatccaaggatgaaacaaggtaagcattcactgattgcttaccacagaatgcggagagatagatttcctaaatattcattttagtgtaaacttcaggttcatgatataagaataaatgagtgtcagaaagaattcagaactcaagaagggaaatatttgcaaaagattgaagactcttagcttatcggattagagctatctggagtgggctagggataaccaaattgttgatacttcttcagcttgtagaaaataaatatactggcaccttttcagaggcagggtgttctaaactccagagccatcattgggctgttaagtttcttttccagaaaaactgagataggagctttacacatatgtgaaggtcaccactagctatggtatcatctgggccttcattagaaggggcagagctttgtaccagctgtttgctgttagcccaggtttagcactttcatgtgcctatctgcgttcaagtttggacctaaatgtggggaaaagaaagaaagatcagtttgttactgtgtctatgtagaaaaggaagacgtaagaaactccattttgatctgtactaagaaaaattgttctgctttgagatgctgttaatctgtaactttagccccaaccctgtgctcacagaaacatgtgctgtattgattcaaggtttaatggatttaggtctgtgcagaatgtgccttgttaacaatatgtttgcaggcagtatgcctggtaaaagtcatcgccattctccattctcgattaaccacggacacaatgcactgcagaaagccgcagggacctctgcccaagaaagcctgggtattgtccaaggtttccccccactgagacagcctgagatatggcctcgtgggaaaggaaaaaccttacatcctccagcccaacacctgtgaagggtctgtgctgaggaggagtagtgaaagagggaggcctctttgcagttgagataagaggaaggtttctatctcctgctcgtccctgggaatggaatgtcggggtgtaaagccaaccattcgttctattctgagataggagaaaaccgccccgtggctggaggtgagatatgctggcagcaatactgctctgttactctttgctacagtgagatgtttgtgtaaagtgaaacataaatctagcctctgtgcacatccagacatagtacctttccttgaacgtattcatgatacagattcctttgctcacatttttccctgctgaccttctccccaccatcaccctgttgccctgccacactcccctcgccaagatagtaaaaatagtgatcaataaatactaagggaaatcagagaccagcgctggtgtgggtcctcacacgttgagcgccggtctcctgggcccactgttctttctctgtactttgtgtctgtgtcttatttcttttctcagtctctcgtctccacctgacgagaaatacccacaggtatggaggggcaggcccccttcatctaaaaggtgttgaaagccttggactatgtgaattaacttagactgcttattggttatcctggaaatcggtaacagcagataaaattaggaaaggagatgattctgcttttaaagtagtgagtggcatgtcttaaccacagagtgcagtgattataaaattccatttgattctttgtttttctcaaattgcataagcagtgagtaggaagaagatgatgaaccacaggaggagtagtcagaaggggagaagaacgagaaaagtaatgtcacagactgtgagggaaaattatccacaaagatgggatgttacagtgtcagatgctgcagaggaggataggtgaagaaagtagaacaaaatactgatggttgttgaagctgtgctgttaggtacatgggagtttattgtattagtctatctgcatttgtcatctatgggttgttttttttttgttttgtttttttgtttttttagatggagattcactctttcacccaggctgaagtgcagtggcgcgatctcagctcactgcaacctccatctcccgggttcaagcgattctcttgccttagcctcttgtgtagctgggactactcaagacaggcatacaccaccatgcccggctgtttgtatttttagtaagagatggggttttgccatattggccaggctggtcttgaactcctgatctcaagtgatctgcctgccttagcctcccaaagtgctgggattataggcataagctgccatgcctggccgatagatatatggaagttttttggtttttttttttgttttttgaggtgttgtctcactctgtcacccaggctggagtgcagtgacacaattttggctctctacaacctccacctcacaggttcaagcaattctcctggctcagcctcccgagtagctgggattacaggcacccgccacgatgcccagctaattttttgtatttttagtagagacggggtttcaccatgttggccactatggtctcattcttctgacttcgtgatctgcctgcctcagccttccaaagtgctgggattacaggcatgagccactgcacctggccaatatatgaaggttttcataataaaaagttaaagacaactcatcaagatctttaggaaaatcaaagtttataaagctgttgtgtcttacctaataggtatctgctttcacattcttatgatgaagaatcatctatactaatctcacgagatgtagaatattaaggagcagtaacttcttgcctagaaaatagcagatacttttattctttactgtgattaaaatcaatggggccggtcatggtagctcacacctgtaatcccagcattttgggaggccaagacaggaggatcacttgagcctaggagtttgagaccagcctgggcaattgagtgagacctcatctctacagaaaacaaaacaaaacagaaaaattaaaattaaaaaacggtagttaggcctggtggcacgtgcctgtagtcccagctgttggagtggggagggtgcccaaagtgggaggatcacttgagctggggagatcagtgagctgagatcgtgccactgtactcagagtgatgacagttagaccctgtgtcaaaaaaaaagaaaagcaataggacaggtttaaaaaattacataaatatctgtagactgaatactattatgtctcttttgtctttttttagtattattatatttagtagaagatttcttgaattcctgaaagttcccgcataaaatgttttagtatttcagtttgctttggtcatttacctcttcttttacacaataaacctgtatctttgtataataagtgggtatgtaaaaggttctgttatgccagtgtgttgttgcttgtttgttttctgcaagtctctttcttaacagtattttcatcaaaccacttgtactctggacatctttaaatttattataaaggcattgctggatcccctacttaatgctatttaatcaatgctttttatcttcctaagtgaatcattgtcataaataatttggggaacaatgtcttctgggtttctgagactgcctgacaaatctttgagtatgtcttttgtgttaagcataagttcctgtgcatcagcttttattccagagcacacacacctttgagatgacaggtttgaaaagcattttgtaaactgtcaaaagctgtttaaatgttactacacaataatgagtagtagtcatagctgtgactgccttttctcctttgcttttgtttgcagatttcatgactataaaactaaaaggcagggaagtatatatgtagtggacaggtgcttcgcatccttccctccatcctcatagttatcgtttaggaagtttactaatagccttaggttattttagcttttgatcttaattcaagcactgtctgtatcataaatgtgtttattgatctgttttccccacagcatgtctggatgttttatgtttctcagtgttgtcttctgtttatttgtttatttttatgaagtaccaagattattggtgcctgattttcaagattttgtcgttagatgtgcgttctttttttttgtttttaagtttattattatattttaaagacaggctctcgctctgttgcccaggctggtctcaaacttttcacctgaagcatttgccctatctcggcctcccgaagtgttgggattacagacatgagccaccacgcccagcacatgtgccttcttgattgttactctttgatttgaacatttatgacctgattgtactataatagcattttggttgtctgaggttctctatcctgtccataacttatgaacttatttataggtcagatgtatatgtatgttgaaattagcagatgtttgtaagattgtggaataggggaacaaagttatagtagcacataattagcagctaattgcttttctttttttacttttttgtttgagaccgtgtctcgttctgttgcccaggctggagtgcagtggcgtgatctcagctcactgcaacctccacctcccggattcaagtgattctcctgcttcagcctttcaagtagctgggattataggcatgcaccaccacgcccagctaattttttgtatttttagtagagatgaggtttcaccatgttggccaggttggtctcgaacttctgacctcaagtgatctgcccacctcggacctcccaaagtgctgggattataggtgtgagccaccatgcccagccagctaattgcttttcaaagccaattggtggtgttggttccactgacaattctgtatactgtatagatttccggattgattttcaaaatctatttttagttttagcctcacactttactaaaataacttaaacttattaaaataaataaaataaaccgccagtactattttagtatggccctgcttctcaaactttagagcacattagaatcacctggttcattagatttggggtgggactcaagatttgcatttctaacacatttccatgtgatgctgatgctgctagaccagggtctacattttgagaacacaatggttagacacacacgtttttgcaaattataactattctgggaaataataacagatagtaaaaacagacttcttatataatttttcattatataagaagtctgtttccccaaagtccgagcgtgcagaatttgctagaactgtcaatctgtcttaatttcatacccttttgagagctgctttgaatcttgttttttttgaactgttgtttttatgtttattattagaaaataatacgattgttttaaaagatgtaaattaaatagtgtgtaaagtaaaatgtataaagccttaatagaagaaataatatttgacctaagaccttaaaacagagctataaactgtatatgcatgtcttagaggaattggagggaagaaggaattctaaatggaaagaagaaaaacaaaggtggtgagaaacacaggttgttttgtaggaaatctttaatcataatatttggctaaaggtgcagtaatttcaagggagaaatggcatttggtgattagaaagtagaatcagtcaatatatatttatttgcctttatatgatagacactatgctcaacatgtctattcttccttcagttagtccttaaacgtttatgagttaggtactattgtctcatttttataggtgatgagaaaacaagcttagaaagggaaaggaacttgcttgagttaatagcgttaagtgggacagttgaacctggaacagccttaccttcagagcctgagctcgtaactatcatgctttactgccacctgaagttgggatgatatacaagtaagtgcttagccattaataaatgttatttttattgttagataggttgggaccagatggaggtttgcaagtaaagacttacggaattttttttttttaaaggaaaggaatgtcttttaaaataatttgattttgttctgttttgttttgttttaagactgagttttgctctgtcgcccagatgggaatgcagtgacgcgatctcggctcactgcaacctctgcctcctgggttcaagcagttttcctgcctcagcctccgagtagctgggattacatgcgtgcaccactagacttggctaattttttgtatttttagtagagatggggtttcaccatgttggccaggcttgtgtcgaactcctgacctcaggtgatcttcttggccttcttggcctcccaaagtgctgggattacaggcgtgagtcaccacgcccagcctaaaatatttgaacaggagattgtatgatcagaactctgtaggaaaaaatattttgacagtggtatatagtttggattatgtggtggtgagtgaaggttgaaagtcctatatggaaatttgttacaataatctattgagaggtaacgaaggctagaactgaggcaatgatggtggaagagtagagggagaatgtgaaagtgggatcaacaggacttagatactgagtgtcaagaggcacagggaggaaaaatgtaaaattgcctgggaaagacagcagtatcgttcatagaaccaaaacctaagaaggaaggaagaccataggaagagaatgtttagagggacgggaggacctggcagggcatggtggctaacacctataatcccagtgctttttgggaggcccaaggggaagattgcctcagcccaggagtttgagaccagcctgagggacaaagcgagaccccatctctacataaaataaaaaattagccaggtgaggtagcatgctcctgtagtcccagctactcaggaggctaaggcgggaggatcccttgagcccaggagttcaaagttgcagtgaactgtgattgcgccattgcactccagcttgagtgacagagcaagactcttgtctttaaaaaaaggaagaaagggagggccttgggatgggagagttattctagatctcctgcatttagttgataatttgatactagaggatgggagtgagataaagagtagagattgatttgggaatcattctctgagataaccttagaaatcatggaatttgagatcctagggaaaaatctgtggagaaagaaaaggagaacaagaacacaatcatagagacctatatttagtggatggtaggaagaggacaaaccaaaaaagggatgatgagaagtgggagtacaagattacaaaagcactgtcacagaaattaagagaaaaatgttctttaaaagatgggacatttggccggtggcggtggctcactcctgtaatcccagcactttgggaggccaaggtgggcggatcacttgaggttaggagttcaagaccagcctggccaacatggtgaaaccccatctctactaaaaatacagaaaaaagttagctgggtgtggtggcatgcgcctgtaattccagctactcaggaggctgaggcaggagaattgcttgaacccgggaggtggagattgcagtgagctgagatcatgccactgcactccagcctgggcgacagagcaagattagattctatgtcaaaaaaaaaaaaaaaaaaaagatgggacatttaacactatcaaacgctgcaaaagagaattaagtcttagattaataagctagggaaaactggctgtttggaaaaagaaaagaaaaatcaggttaacgccttagcttatcccaagatgagagtagattcgatgttgacttttaaattgattttaaaaaattaaactaaaacctctagaagaaaatatgaatagttaattcattgctgaataaatttagctatatagaaatataaaactcttataatttaaaaatgtattatcaaaagcaaaggaaatatttaaccaatatgagatgctcagtattctcaggttgtaaagatctcttaaaaataggcaaaattattcccttgtaatagataaatgtacaaaaaacatatatatagttcatgaaagaagaaactgtaatgacctgtaattatatgaaatattgttcatctttaattttaaaaagcattaacatttttgcttaccaaattggcaaagattttaaaactttatggtgaaatgggtgtttttattttgcggtacataatttgaaaatgtccagcaaatgggagaacaggtcaattattacctttaaaactattttttagggccaggcacagtggctcatgcctgtaatcccagtacctttgggaggccaaggcaggtggattgcttgaatccaggagttcgagaccagcctgggtgacatggcgaaaccctgtctctactaaaaatacaaaaaataagtccagaatggtagcctgcacctgtagtcccaactacacaaaaggctgagtcaggagaatctgtggaacctgggagatggaggttgcagtgagctgaaatcatgccactgcgttccaggctgggtgacagagcgagaatctgtctcagaaaccaaaaacaaacaaacaaaaaaacactattaaaaagaaacaatttaggccgggcgcagtggctcatgcctgtaatcccagcactttaggaggctgaggcaggtggatcacctgaagtcaggagtttgagaccagcctggccaacatggtgaaaccccgtctctactgaaaatacaaaaattggccgggcatggtggcaggtgcctgtattcccagctacttgggaggctgaggctggagaatcgcttgaacccgggaggcggaggttgcagtgagccgagatcgtgccattgcactccaccctgggggacaagagcgagacttcgtctcaaaaaaacaaacaaacaagcaaccagtatttttcagctttcaaaatatttgcatgttttgacttggttgttctattctgcagtctgtctaaaagaaataagaaatccaggcagggcatggtggctcacgcctgtaatcacactttgggaggccgaggtgggtggatcacttgagcccaggaatttgagaccaccctggtcaccatggataaaccctgtgtctacaaaaaatacaaaaattagccaggtgtggttgggtgtgcctgtggaataggaggatcacgtgagcctggggaggtcagggctgcagcgagcagtgattgtgcctatgcactccagcctgggcaacagagtgaaacaatgtctcaaaaaaaaaaaaaaaacccaaaaagaccaatgaaaagaaagcgattaaattgtagtatgtctatatataattttctgcagtcattcaaaatgattttcagtaatttgggggaaatgcccaatatgtattgagtaactaaccaaataaaaacccacccagaatatgaaaccattatacagtgtgtgattgcagtcacatccaatgagaaggactgacaagagatagtcctatgtcttggtggtaattatctccaggatgtaggatggcagataatttttattttataattagaagttacttttgttctttgaaagtctgttttaaaaattaaaatgggggctaggcgcagtggctcatgcctataatcacagcactttgggaggctgaagtgggcagatagcctgaaccctggagtttgaaactagcatgggcaacatggcaggaccttgtctctacaaaaacatacaaaaattagctgggtatggtggtgcatgcctgtattcccagctactcaggagactgaggcgggaggatcatatgagcctgggaggtgaggcgggaggatcatgtgagtctgggaggctgaggctgtggtaaaccatggttgtgccacggcactccagcctgggtgacagaggaaaaccctaagggaaaaataaaataaaatgcactaactatattaactgcattttaaaaaagagtatagtgaaggaaaggggaatgggaagacagcttgaggaacagataggattgaggaaacattttaggtttgggtgcttgattatatttgtagagtaagacaaaaggtctataagaaaggaatataatgaagatgcaagaaagcattaaaagatgttgggcagtcctagaggatatagtctgccatccaggacatgataggcaaatcatccttgaagaaggggagagagactttttcagacatgggaaacagatggagatggttagtggcacagagaaattttaaggtatgggagaaagttgagggatagcagataatcattatttttagggaagaggaagagtcagggatagctacagattggtattagcaatttgaggagatggaaaaggtttgcaaggggcactggggatgggtccaggagtggattagagatgtagaaactgattgatttctaaacaatatagataacccaattaaagttgttgaataatgtcagctgtagccaatgttggcttggtctctttgacataatccagttttaggtatttgaatactctataaatacaaatacatagactgaagcacaattttaatttttttctatcttttgcctaggtctgtatgattgtataggacttagagctttttgtcctaccaaattattaatttctttattcccattaattttaataccagcacactaatctcattaaacccatggttttactactaggttgtcaaagtcatccgtcatttataattccctagctcccaggagtcttgagctgtgattttttggtttgtttgtttttgggttttttttttttgagacagagtcttgctctgttgcccaggctggagtgcagtagcacaatctccgcttaccacaacctcagcctcttgggttcaagcgatcctcccagctcagcctcccgagtagctgggactataggcgcatgccaccatacccagctaatttttgtatttttagtagagatggggtttcgccatataagccaggctagtctcaaactcctgacctcaagtgatctgtccaccttggcctccttaagtgctgggattacaggcgtgagccactgcagccggccgatttcttctttttaataagaggggagaaaagagtttttgtctttaataattggtagtgaaaacctctgaccttttctttactgggcccagtggaaaatttattagaattgtttgtagagcagcctgccctttaatatgctactttacttagtttatttactccactaaaatacacctgacttctcaactggaacattctccagcattacttgttggtctgaggaatagtagtgtaaaaagtagatgaggggttagttgtggtggaagaatttctgggaggggaagcagttgggcaagggtgaaggaattgaaactactagggaaagtagcctatgatgaagcccaagtgaggcgtgaagtgagctgatgaactgtaaagattctggaaggagttgaaggttgtgatgagactgaataaaagatactgtaggaggcaggtagaataaataggaagttgtagttagagggattttagagttcaagatctaggaagaggaacaattctaagtatcaaggaaatttaaggagttgtacgggttatcagatgactccattgaaaaattgagatcaaaatgttataagggtgtacagcattgatgttaaaattccccaaattttaatccccagcaacaaatcatagcatttttggaatcctgtttctgctgtacctttatcatagtaggtttatctcatgcactgaatgttccttctccctcacatatccctaaaacttgtctagcactgaatgtgcaatttagtatgaattttctagctgaaagatttttaggcatcttgtagtcaagataatacattttaggatgcattcttgggtcacataactcatcagtagcagagtcagagctagaaaccttaatttcccaatttttggtctattctactcattgttatctgttatttaaaaagcagcaggaactcttctttcaaactagttaggaacgtcttaaaatagcatggagaggcaatacgcagtcttaaaatggttttggaaacctcacttagaagaagagaagcagtgtcaaagctgactcttcctgcattcagaccatgttctgcaggtagtcaacactaatcaggtgctgactgccaattactgaggtgttccctctattataagcatttggggaacccccaaagtagtgcttgtcataccttactgtccacatatataatctggggatcttgttaaaatgctagctctgatatagtaggtctagaatagttttgaagattgtgcatttctgacaagctcctgtatagtgctcgtccgtttggtttaaagaccacactttgaatagaaaggccctaaaggatttctgtggtacacagtttgaaaatgtcttttaaaatatgaggactggtacgcagtggctcgtgcctgtaattgtagcactttgggaggccaaggagggaggattgcttgaggtcaggagttcaagaccagcctgggcaacatggcgaaaccctgtctctacgaaatacacaaaagaattagctgcgcgtggtggcaggtgcctgtagtcctacctactcgggaggctgaggcatgagaactgctagaacctggtaggtgaaggttgcagtgagccgagatcacaccactgcactccagcctgggcgatggaatgagacgctgtctcaaaaaaaaaaggaaaaagaaaaaaactatgtgaggagagagagatgttaattagcttgactgtagtactttttttcactatgtatatcaaaacatcatgttatactgtttttattaaaaataaatcattgcaatacatgttttacagaaaaaaaatttaatacatggtactgcctctctgtttctttgtttgtttgagacagggtctcactctgtctcccaggttggagtgcagtggcgcaagctcagctcactgcaacctccacttcccagactcaaacaatcctcccacctcagcctcctgagtagcttcgactacaggcgtgccctgccatgcccagctactttttaaatttttttgtacagacagggccttgtcatgttgcccaggctgatctgtcactcctgcgcttaagtgatcctttcacctcagcttcccaaagtgctgcaattacaagcgtgagccacagcacccggcctctgttagttgaatctattagattttattttgttcaggcttattctgaaattcctaggagtatgggttagtactgtgtagtggtttggaggtagtacataccagagccttggctgagacatctgcagactggctacttatgcccttgtttctaatctatgactagagcccctctggaaggaaaaggaatcagctatatttagccaacagtagcagtagctttcagtctgacatttcctgttagtgttcttccctcctttctatccctccagttgatgtcattgctttgaagaaatgacagctcctttaaaaaaagtctgtggttacttctactctaaatcactagctttgaacattttgtgtaccattgtactgagctgggggatatcagggcctagtccctgggaaatacgtgcactttgttctcctagcatgggaaaaccagacctgcctcaaacttgaattaatagccagtggaaatcaagaaacaacaatggtaaagttatctgtgcttgtgataaaatagtgccctaaggattttgagaacttgactttgttcctgttcatatagggccttctgaaggcttatttgaaatatgaaccagcatacctaatagttctgaatggccacaagtgttcctatgcccttggacaacccatcactctatctctagatgaactctgggggttatataggattctacccaaaggctctttatgtatttaataaggctgaccagaaattaaaaagcttttttgaagctcttaaaaacttagaagttttcatcctcctgctgttttttttcttaaattcaaggagtattcattatttccctctcccccttccttttcccctcttcttacccagagtgagcacaaatggatcagatgaccctgaagatgcaggagctggtgaaaataggagagtcagtgggaataattctccatcactctcaaatggtggttttaaaccttctagacctccaagaccttcacgaccaccaccacccaccccacgtagaccaggtttgtattccagctctcaatactcttggaaataatgtcctggttggcaattaatcctcaggtaagtgtcaggaaattcttttaggtgaattttctgcgtgtatttttacatttaagattttggaaaagaatgatctttctgtaggtaaccaaaagtgcctttttcctaagtttttgttcaaggtgacgttactgaggcagtgctctactgagaatgaaaatgacatgtgcgtaatataaagtataggcggtgcagataacatggcaataacattgtacctttcttaaatggtttgtaactataacataaatgtattaaatactcaaggatttggttgcttattcctagtatatcctttaaaaagttagtaaacgaaaacccaacaatgctaaatgacccagattttaaataaaaagtacacaacaaacaagcatattttaggtagtaaaaatgtgaacacctataagactatccacttctctgatagccagaacaaatctttaatcttaccttttattgtttctctctgctaatatgtgggcagggaatgcagtgtagttaaaccaaatattactagaaaagtacattagttctctgcaaataattttaagtgaatttctattcaattatacatcttctcctttttatttttttattttttgagacagggtctcactctgtcacccagactggaatgtggtgacatctcagctcactgccacctctacttcccaggctcaagtgattgtctagcctcagcctcccgagtagctggtaccacagtcatgagccaccaatgcctggctaaatatttatattttttgtagagatggagttttgccatgttgcgcaggctggtctggagctcctgagctgaaagtgatccttctgcctcggcctcccaaagtgtgggagttacgggcgtaagccactgcagccacatcttccccttttatagataatttgattaattgtatattctgagtctttaagatgtctttattataatcttggtgacttcctctagacattgttttgtccacaagtatttcttaaaggtgtaatgtatgactactaactatctgtaagaatgttatttcttatcagaccttccatattataaccaacatcaaaaattggtctgtaatctgcacggtttcacaggaaagcagttttaaggagctggaaaattaataaatgaacttaaaataccaaggaatattaataatttcctattctaaaagtttttatttccagtgacatcagaagatcagagaacctgtacatgcttcgtgattagtaatgggacataggggtagacaggaccgaaaaagtaaacaagcctattaactggcagcgttggttatttcccattacttatttctttaagtaattttcacctgtgcatctacatcttaagttttatatttatcatctgccttttattttttacagttaaaattctatcctgaattttagaaaatgaaagattcttttcctattttccccaaatcttttatagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctgggtgagtaactttttaaattaacatatgttgtctttaggattcttcataagcctacttattaataaggaaaataacagtaaacaacagtaaactccattgttttgatgactgttttttaatttcttttttttttgagatggagtgctctgtctcccagactggagtgcagtggtgtgatcttggctcactgcgacctccgccccctgggttcaagtaattctcctgccttagcctccctagtagctaggattacaggtgtgcactaccaagcccggctaatttttgtatttttagtaggggatttcaccatgttggccaggctggtctcgaactcctgacctcaagtgatccgaccacctcaacctctgaaagtgctgggattacaggcatgagcacccagccaactgtttttatgttattgtaactgattttgggggatctggagtcaaaatgaacaaggaaaacacaccatatttgaaatcttcagggcaaagtggaaaaatatattttttcatcaaaggaccctgaaagttaaccaaggccaattaataaaataatcacctaattccaattgcctttttctttaagggggaaaaaatccctttttaatatcaaactatttttttcatcagaagatcattataggctgggcatggtggctcacgcctgtaataccagcattttgggaggccgaggcgggctgatcacctgaggtcaggagttcgagaccagcctggccaacatgctgaaaccccatctctactaaaaatacaaaaaattagctgggtgtggtggcaggcgcctgtaatcccagctactcgggaggctgaggcaggagaattgcttgaacctgggaggcagaggttgcattgagccaagatcttgccactgcactccagcctgggcaacaagagcaaaactccatcttggggaaaaaagaaaaatcatagcaaagtgatagataattcagaaaactgagaaaatttgtgctcataatcccattttaatctctcctgattattttaagattattttcatagattgtttttaagatactcaggtgtaattttttcttgtttattttttgtttgtttgtttgagatgaaatcttgctctgttgcccaagctgtagtgcagtggtgggatcttagctctctgtaacctccgtcttccgggttcaagtgattctcttgccttagcatcctgagtagctgggattacaggtacctgccaccatgcccagctaattttttttttttgagatggagtctcactctattgtccaggctggagtgcaatgatgcaatcttggcttactgcaaccactgcctcccaggttaaagtgattctcctgcctcagcctcctgagtagttgggactacaggtgcccaccatcatgcccagctaatttttgaattttcagtagaaacggggtttcaccatgttggccaggctggtcttgaactcctgacctcaagtaatccacccgtctcagcctcccaaagtgttgggattacaggtgagagccactgcgcctggccatttctttccactcaaatcctgattataccctgattgagagtgacttcggtatcctaggtagacggacctcaagcctcttcaggaatatgttttctcctagagcagatacttgcatagaagaaattgaattcactgtgtgccactgcctgaagattacatttcttcactttattcctaaattgtatttgtatcatctttctaaactgatgtccttatttgccttagttcaataatggtcatttaatggaaatgcaaagacaggattaaaaagccaggtaactcatgcaagtattttaccagccttttaattttgtatttaagttgggagcagagagtggaccagcacgggcgagtttactatgtagatcatgttgagaaaagaacaacatgggatagaccagaacctctacctcctgggtaagtatctaaatttaaaaagaataattttatttagtcagaattgtggattacaactgtataatcttccctacatttctgttttactttttcttgtcagccctttctctgtccactttgttttgtggtaagtacaaattaaaaagaagagagctagacaactgattaattcagagcctgataaacaatttttgttttcacgcatatttctttcttcttttctttattttatagaaacaacatctcgctatgtcgcccaggctggtttttaactcctgagctcaagccatcctcccgcgttggcctcccaaagtgctgggattacaggcgtgagctatcatgcctggccctattttcactcatttctgacctaaagattccttaggtgggctgggcgcagtggctcacgcctgtaatcccagcactttgggagggcgaggtgggaggatcacgagctcaggagattgagaccatcctggctaacgtggtgaaaccccgtttctactaaaaatacaaaaaaaaaaaagccaggcatggtggcgggcacctatagtcccagctacttgggaggctgaggcaggagaatggcatgaacccaggaggcggagcttgcagtgagccgagatctcgccactgcactccagcctgggcgacagagcaagactctgtctcaaaaaaaaaaaaaaaatttccttaacttttcttgtctaagctgtttacctgtttactaatactgtagtttaagtattagtttcttcaagagtaattatttaaatgaataagaattagagcccagtcatatattaaaatgaagttcttattatatttaaaaaactataatagcaaaatcatttcaaattaattggggaagttaaggatatattaatacatggtgttaagcctttaacattaacattaacattacagtccaggcacggtggctcgcgcctgtaatcccagcaccttgggaggctgaggtggggggatcatgaggtcaagagatcgagaccatcctagccaacatgttgaaaccccgtctctactaaaaatacaaaaattagctgggtgttgtggcgcgcctgtagtcccagctactccggaggctgaggcaggagaatgacttgaacctgggaggtggaggtgcagtgagctgagattgtgccactgtactccagcctggcgacagatcaagactccgtcaaaaaaaaaaaatcatataaaataattgaagaaaaaatattttttaatccagaggaaagtcagtaacaaacatggaaaaatacttaaccttgttagtaatctgaaggaaatataccctgaaaaggtactgttttagttattaaattagcagataatatcaagtgttggtgaggaactttacgttgttagttgctgccggggctgggcacagtggctgatgcctgaaatcctagcactttggggggacaaggtaggatgggcgcttgaggccaggagtttgagaccagcctgggcagcatagtgagaccccatcactatagaaagaaaaagaaattagctgggcatggtggcatgtacctgtagtcctagttaatcaggagtctgaagtgggaggatctgttgagcccaggagttcaagattacagtgagctgtgatcatgccactgtactcctgggcaacagagccagcccctgtcatcctccctgcatctgcccaccataattatgtattaatacatacccttcataatcctctctgtgaaatttatcctaaagaaacaattcaaaggaagaaacagtttgctacattaagaatattcattattttattatttatataacatcagaatattggaaaccaccctaaataaccaagcaggtagaaatcgtgaagtcattcgattcatttatgaattatgttcataatcaacacaatcaattctttcaaatgttttatttagaacatttgtatcaatgtttacttacatattttgtacccatttaaaatgataggaagtgggctgggcgtggtggttcacgcctgtaatcccagcactttgggaggccgaggtgggcggatcacctgaggtcgggagttcgagggccgcctgaccaacatggagaaaccctgtctctactaaaaatacaaaattagccaagtgtgatgacgcatgcctgtaatcacagctactcaggaggctgaggcaggagaatcgcttgaacctgagaggcagaggttgcggtgagccaagatcgcgccattgcactccatccagtctgggcaacaagagggaaactctgtctccaaaaaaaaaagataggaagttagttgtgttcttgcgaaaaattgtgtgtgtgtgttttgttttgttttttcgagatggagactcactctgttgcccaggctggagtgtattggcatgatctcggctcactgcagcccccacctcataggttcaagcagttctcctgctcagcgtcccgcgtagctgggactacagatctgcgccaccacacctggctaattttttgtatttttagtagagatggggcttcaccctggtggccaggctggtcttgaactactgacctcaagtgatccgcctgctttggcctcccaaagtgctaggatcacaggtgtgtgagccactgcacctggccaaaaagtgctttttgatatctgtccaaagctatatatttaatttgtgtccctgttatgattgaaacagtaaaaacaacattgaaaagaaactcaaaacttaatgactgtttgagacttactcactaaatatgtattgcattttaagaacctgactaatgcatcttatgaactttcaagaaataaatttttagaaacatttctcttaagttcacttacaaactatttaaaaatacataaaagactccagataaatcaaaagtagtttctcaaggtaaaatattctatctgtttcacaagtatttgttgaattagcttgtttttttttttttttttctgatttagctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatggggtgagcagcctgttgtttaataaactaataagagtattttgtttctagccccttccagcatatgtcatggaaagcactaaaaagaaggtgcaagtagcatggcaacccagttgttgctgttagtaggtattatttttagaccttgtctggggtattctgtgtgtgatctagtttttcctttttgtaatttgcttaagtccaacttcctcttctttttaatgtcaaaaataagcaaaaaataagttaggacaacttaaaattcatgaacaaaagagtagtaaaaataaacccaagcagcttgaaaataattaaaacatttctaaatttactagtgccttgggtctaagagcatctgactctaaagtggttgtgcaaaactgatgataagagtttaaccactttttaccatttggagataaggcttacctaataaattatttggtactctgggagactgaagaaatttgatcctttataggagtatgcttactatattattctggctttaaatctttattatctttgatataaaatcatttcccttctagaaacaaatggtttaaattttacatattttcctgtagagcaatattgcattaatagtgtaagtactccaaaatcttcctttgctatgcagtctttggtgctaggaattttataatctctcaagtcatacagtatcattgatcttttgtctggaggaaaaggaaaataatccattgagaaatttgattctctatgccaaacaagatggatttgttatatagaacctaaacgaagaaaatcaagccttaaggagctcaggagaaaatgccccctccatcaccatctcttcccctccactgccattggtatcatccctgttagaattcatcagagtaaaacagcacctttcgtattcctttcctaactaggcatagttttatcccttttcttcatattcttgtctattccttatacctcatcatcataatagcactcactgctgtagacaaattcacctttatcagcagccttccctttgttccttggttatgactcaggtacttttctttcatataacaattttttcctgccactttctctaaacagttgctaactatatttcccctcccagtggttttaaagctgaaatgaattttgtctcttgtgtactttacccttcttttcatttttttttctatgctgttttacatcttccttcctttctaaattataatcacctgtggtatgcctggccaaatttcttctaggtttgaatacctagcttgcctgccttctttaaaactagtttccacatgggtgttcagtggaaagagcatgggctttggagttagacacatctgggttcgaatcctggttccacagttactttctccatatgactttgagtaagttacttaacctcatcaagacttatttcctttatctgtaaaataaatacagatataaaattgcctcagagtttttctgaggattctttaaaataaagttccaatatatttggcatgtactgaatgcttagaaatgttagttcccatctcttctctccttcatattcacctctgtatatgtaccctttatctcatttttgcattacacaatctttcaaagcattcttttaaaagagagatttagcagatttctggagcaccaacggtgtgttttgactactgtaatcctgaccgatttagtactcagagtctttggaatttttttttttttttttaagtacagcttctccttcatcatcctgtccccccgcccaatccaatataatctgaacaattttctgaaatttttactctttgtacttgatgtggagtggtttgaaattacatagaatctaaacagcctattttagttaacatagccaaagatataagctgaagtgaattaatttaacatccttaataacatttactttaaaaatgatggggtgttgctgagaaatagtctgtttattgagtatatgaagtggcctttgtccaccattgttgttgtgactcttactagcatacagaaactgtcatacacccagcattttaagtctcagagtggatatggttgacagtaaaacactgtgaaatggttcttcctggtccatggcttaattgtgcatgtccctagtttatccgtccagggagagccagtggggttggcttcagtcttaaaattgtcagtacagtatgtcacgtgccaaacttttcagacctcatctgtaacttgggctcagaccttttgtagtgtttcccgctggcctccctgttctcacatcttctcataatcatgtctgtcaggaggagcaaggcagttctcgacagcactaaatccaagagttattatatcagtagtgtaatgtagctcatatcctttaaaacctcatcaatcaaccaggtttctgtagtaggccggtgacatggggttgtaggggtgggtaaagaaacaagaagagatagcaggggagctgctctatattgagatttaagagaaacaaccaaatgtaacgtaaggactttgtttgggtcctgattttaacaaataagcaatcatgcatttaattacagattaggtattggatgataaaattaacattgattctttaccacatgtcataatgacattgtgattatgtaagaaaatgtcagcctggcgcggtggctcacacctgtactcccagcactttgggaggccgaggcgggtggatcacgaacaaggtcaggagtttgaggccagcctgaccaacatggtgaaacccggtctctactaaaaatacaaaaagttagctgggcgtggtggcgcgtgcctgtgatcccagctactcaggaggctgaggcaggagaatcacttgaacctgggagccggaggctacagtgagccgagatcgtgccactgtactccagcctgggcgacagagtgagactccatctcaaaaaaaaaaagaaaagaaaatgtccacaaattttagagagacatactaaaatatgtagtagaggtgaaataatgtttgattttcgcttcaacaaagaacaggagaaaagagataaagaaacttggcaaagtcttgataagtgttgaatcctggtgctgggtatgtgggaatgtgggattcattgccctgttttacttgttttttttttcttccccatagtgaaattatttttaatgcagttagactcttgtttatcttactgaagaagaaagggtttaaccaaatcttactgggtgaccatgtaattatctctacttaattatacatttaaatcaaaacagacttaatatctctacacagagtcggtgtgacttttgttttctttttccaaaggttgactcttactttgctttcatcttatctagccaaatctttctctccaccaatgtgatcattggaaacagaacttttaagaagtcttccatacagttctaggctcattaacactttccagctggaaacctttccttccactcatctggcagcccactcttcctgttcccccaactctcttctcataattctttgtatgtcacatgttctgtatttgatcttctgtttttgagttacacatataatatttttcatagtcatatgatgattctgggtactggtattgtaaatgacttttgggggggttatatatttttctaatttttatattattgatgtaaaatttgtagcacaaaggaaaaatggtcattttggggatgaggattacatatatgtgtagtattttaattttaaataattttaaatgttaggtaatgtttgcaccggttttttttaaaccaaaccaaagtatattggcatttatccataaccatgtgacacttctttaagatacaaactctctgtgttatacattgccagggaagggaaatcagaactcataagcttgctgtcagataagttgttaagttgttaatagtttcatcactttttggttctttttagaatcaagatttatttgctacatcacaaagtaaagaatttgatcctcttggtccattgccacctggatggggtaagtcacatgagtttcttcatggagttctgtcatttcatttttgttctcttccaattgtgtcattttaaaacagatatttatgtctgatactgtgctcttgcttgagtgaatgtctgggaagtttttttttaatatatatatcagtttaattcacaaataggcattaaattccccaaacattaagtggactctttataaacttttattgacgctcataattattttactcttctacagtttaaagatactgatcacccagcaataaaaaaggaatgggctattgatacaccagtaggtctgggtggacttcaagagtaatttgcttgatgaagaaagtcagtctcaaaagatcacaacctgtgtgattcaattcatataacattctcaaaatgacaaaactagagatggagaacatattagtacttgtcaggaaacagggtaggtgggaagtggattcaaatattaaaaggtaacataagggggttttacgtgatgatgatgattccatcatcttgattccatcaagatccacaagatgattctgtatcttgattttggtaataggtgattacattaataatgtatacatgagataatgcatagaactatatatttacagaaatgaattcagcttttaaacatggtgaaaatttaacaatgtttgtggttaacaataatgtaccaatgccacttctgtggttttgatgctgtacgtagttatataagatgtcaccatcggagaaaaatgaagtatatgtgagactttttgtgcaattttttacatcctgtgagtaataattaattcaaaataaaaagctttttaaaaaattgtaatcacattggttctcctaaaacaaggttcagagtttggttaagttggcattatctgatagaagagtggaaggagcacatgtgaaggtgtcaacttcatgccctacaccatggagctcaagagcatgtgctgttattgagtatatctgataccttagttattaaaatagaccttaatagactttaagctggacctaccctactaggttctattttatagtgttatgtaatactcacagcattatatagcaaggtttcagaataaagatggcagtatagaaagttttgcatagaagcaagataataatatattataatagaaagtggaaaacaacataaagcccattgtggaaccagagttttgtcttcaagagctgaagatacttcataatattgggataaattcagaaagtgatatttctagattgggaaaagttggtccccaagatacattgttctagcagtactgagttatggagaaaaaatgttggtgtgtcaagatcacatgagtctggttaataaatgctactgggggtataagcttttctttgagaaatctcattgctcttatttaaaggtatctattctcaaaacacttctgtgagtcaaaaaggtaaaaaatgtattaggctatacatataactgttactgttattagcttataacaacaggaggacatatgaaagttgtgggcccgatgcagtgacttacacttataatcctaacactttaggaggctgaggcaggtgaatcgcttcagttcaggagttcaagaccagcctgaccaacatggtgaaaccctgtctctactaaaaatacaaaaaaattaggtgggcttggtggcccgtgcctgtaatcccagctgctcaggaggctgaggcaggagagtcacttgaacccgggaggcggaggttgcagtgagccaagatcgcgccattgcactccagcataggcgacagagcgagactccgtctcaaaaaaaaaaaaaaaaagaaattagccaggcatggtggtgcttgcctatagtcccagctactcttgaggctgacgtgggaggatcgcttgagcttgggagtttgaggcttcagagagtcgagatcacactattgcactccagcccgggtgagagagcaagaccctgtctcaaaaaaaagaagaaagcaagttgtgaatttctgtctttaccaaagcttggcagcctggagttaaggagtcctctgtctctactgaagcctaagagtggtcagtgaatggttagtatgaagtactttagaagaggggatgttgcccttacaaggcatattaaacttaacctgtcagattgcattcccagacatggatggttttatttctagagtttcccagctttatttctagagttgtatgtcttatgttagagaaggagaaaaaaactcatgcactaaaatgatatatccaaaggatatgtatttatcctcttaattttattgcaggccaggcatggtggctcacacctgtcatctcagcgctttgggaggctgaagtgggaacattgcttgagcccgggagttggagatcagcctgggcaacatagcgaaaacctgtctctataaaaaaatacaaaaaataatctgggtgtggtggaacacctcctaatcccagtttcttgggaggctgaggtgggaggatcacctgagcctgggaagtcaaggctgcaagtaggccaagattttgccactgtgcttcagcctgggcaacagagtgagaccctgtctcaaaaaaaaaaaaaaaaaaaaaaagttgcagaaaaactatgacctgcttcatggttatggtcagaaacaaaactgttttactccttctctagggcaggtgtagaaaaaaatgcctcttgcttatagaaagctgaattgtgagctgcgtttcctttatcagaaaagtctttcctgcaagttggtccttgccttctgtattcatcattttctttatcatccagatctttctcatttttactttagccaacaacactttgctaaaatactgtgttaaagatccagcttagccaggttattagagtcttgttctgctattttacagtctgcttatttttaggtttcacattcctcatgttgaagtagtgctacagatgtttatgattatcctactcagactgagcactgctttatgacttgctgcctttggggcatataccttacttgtagaaccagtgacagcactggtagtatatcagatgaagcaacccacccaacataccttcaggattgacccaggttgatagaatcccatcttacagcttgcaccctttcagacttttatatgctgggactagacattcctacctcataggctcagtgaataattggttttttagagatgggggtctccctgtgttgcccaggctggggtgcagtggctgttctccagcatagtaattgcacactacagctttgaactcctggcctcaagcaatgcctcagcctcctgagtagctggaattacagttttgtgccacgatgcctagctaggcagtgaagaatttttaacacatgaacatactatagaggataaagaacaaagaatacttttggttcaccagtattatttaatagggctttgtataggtgcttcgccaatcaagtatgaagatattctctcattttcctagttactgtgaaagaatacatagaatgacaagaagtgtctgttttttactgttttattcatcaagtcaggaagtgttctaatctgcatttggatttgatgttcagtaatttcagtattgtttattatgtgatttttcaacaaagtcagaaatccgttctacagccacagcacttcctctcattaagtagatgagccttcagttcacaaatgtgtcaaggctgatctcagcagcatatacttagaatatatatgagaaaaatgtttgctattaattttctcttgcctcatgttatcttctgaaaggaaaatcttggcctgaaatctgaactttgctgacagataaaagatgaatggccattacagtggctcacgcctgtaatcccagtactttgggaggccaaggcttgtgtccaggagttcgataccaggctggggcaacatggtgaaaccccatctttacaaaaaatacaaaaattagttgggtgtggcatgcctgtagttccagctacttgggtggctgaagtgggagggttgcttgagccccggaggtcaaggctatagtgcgctgtgattgtatcactgcactccagcctggacaacagagtgatactctttcaaaaaaccaaaagagagagaaaaaagttgagtatgtgctcagctatatacttagggtattatttttaggttataaaaattatttggatatatatttttaaacaagaaagagaattctggctgggtacggtggctcatgcctgtaattccagcactttgggaggtcgaggcgggtgaatcacctgaggtcaggagttcgtgatcagcctggccaacatggtgaaatgctgtctccacaaaaaatacaaaaattagctgggagtggtggtggacgtctgtagtaccagctatttgggaggctgaggcaggagaattgcttaaacctgagaggtcgaggctgcagtgagctgagatcgcgccactgcactccagtccagcctgggtgacagagcaaggctccgtctcaaaaaagaagaagaagaacaaagagagaattctggattctgcaaataaatttttaaaatttaatgcgactgccaagacatgaacttatcttgctgttatgttaacaagagcaagctgtaacactgtgggtgattatgtttttcttttttttttttttgagacggagtctcgctctgtcgcccaggctggagtgcagtggcgcgatctcggctcactgcaacctccgcctcccgggttcacgccattctcctgcctcagcctcccgagtagctgggactacaggcgcccgctaccacgcccggctaattttttgtatttttagtagagacggggtttcattgtgttagccaggatggtctcgatctcctgacctcgtgatccgcccgcctcggcctcccaaagtgctgggattacaggtgtgagccaccgcgcccggcctatgtttttctttagagacagcctttgagttggtgataagcttatgcactgaagatgccttgaccagcaaaacctgtgtcatgagaggcagagtcccacttttctgtatattatgcacattggaattctattttcattttaagctaagctgacatagaaagtagctttaaatgtcagaagcaggtttgtgatactcactagttacatccattttaacctctgttatcactactacttgaaatcatggaattatattggaaataaaattaaatattaccaaatacgaacttgacaagactataatttggcctaaaactgatccagatgatctcaagtgttaatttgaaaaatagttaccaatttttcttttttcttttcctgtttttttttttttttttttttttttttttgagatggagttttgctcttgtcgcccaggctggagtgcaatggcatgatcttggctcactgcaacctctgcctcccgggttcaagcgattctcctgcctcagtctccctagtagctgggattacagatgcccaccaccatgcccagctaatttttgtatttttagtagagacggggtttcgacctgttggccacgctggtctcaaactcgtgacctcaggccatccgcctgccttataactcccagagtcctgggattacaggcgtgagccacagcgcaggaccaatagttaaccaatttttcaaaccacaggaaataaaaattagccatgtcaacatggattaaacttaaatttttgtttaaaatgctgatttttagaaactaagctttttaaaaagtttcagttcattctatgatctttaatacatcagttcattctatgatctttaatacatcagttattcattttgagacatgttgaacaaataaattaggatacagcaggaatcccatcttttgaagaattcattggtaatgggacagagaagtcagtaattcaaaaacagcagaactgttaaaatttcaagtctacttaatttgtttactaaaagagaaaatgatatccacattttttttttttttttgagacggagtcttgctctgtcgccaggctgtaatccatctcggcacactgtaacctctgcgtcccgggttcaagcagttctcctgcctcagcctctcgagttgctgggactacaggtgcacaccgccatgcctggctaattttttttttttttcttttttgtattttagtagagacggggtttcaccatgttgcccaggttggtcttgaactcctgagctcaggcagtccgcccgcctctgcctcccaacgtgctagaattacaggcatgagctactgcgcccggccaatatccacatcttctaaaccttaatggggagatttcaggaaagcaggtaaaattttgtagactgggaacacgaaaacagggagaatcctaaagcaagaggcagttggggaacaagcagcagctttagatgcagtaattagagaactgagttctgcttcctatcccttgtatagaaagttactgtagatatttaggattttggaactgggtatattaaggaacgagatatgttaagtgtattaagaaaggaagtattttttagttgaataatgcctagcatataccttatattatattccttattttgtatatatatgtatgtatatatacacactctcaaattacattatattccttattttatatatatttttatatattgtgtgtgtgtgtgtgtgtgtgtgtgtatatatatatatatatatatatatatatattttttttttttttttttttttttttttgagacagggcctcactttgtcacccaggctagagtgcagtggcatgatctcagctcactgcagtcttgacctcccaggttcaggtgaccctcctgccttagccccggaagttgcttctctgtcccattaccaattaattcttcaaaagatgggactcttctggtatcctaatttttttatttgttcaacatgtctcaaaatgaataactgatgtattaaagatcacagaatggattcaaactttttaaaaagcttagtttctaaaaatcaagttgtacaagttgtggggctaaggcaggaggatcacctgaacctgggaggtcaaggctgtagtgagctgagatcacgccactgcactccagccagggtgacaaagtgagaccttgtctccaaaaaaaaaaatatatatatatatatgtgtgtgtgtgtgtatttatatatacaaatgtatatttaatatatatcaaatatatatattagtgggctgccagcacggcccactaatttttttgtattttttgtagagatgagggttcaccatatggcccaggctggtctcaaactcctgagctcaagcaatctacttgccttggcctcccaaagtgctgggattacaggcctgagccaccccgcctggcaccttactatattttaatgaatgaaatgatgtagtatggaaaaaaaaaaaatccctaaatggagacctgagtttccatctcatctctgctacttaattctgaggtttcaggtagattatttaacctatctgagttttcttatcttaaggataaagatgaattcacctaccctatgggactattaagaataaaatgaaggtcctgtgtaaaaaactaaataactgttcattattcttgctgctgttggttggattgagtagaaaggtcctatggttaggacattataaagtacgtctacttagcttctaagatgtaatatttctataacttcagtaaggatgtgcatttaatagtcaataaattaaaccttttaaagctgtgatttaaaaactataaaataaacaatgaaatgagaaatgggcaaattcaaataattttattttaccttgagcaagaagactatgccaatgctaatgctttgctttcccctgcccctgcccttcccaaagagaagagaacagacagcaatggcagagtatatttcgtcaaccacaacacacgaattacacaatgggaagaccccagaagtcaagggtaagaatagttacttgtgtatatttaatctcttaaagattataccttatttctaacaactgaagaagatcaaagttcatattcttttgccaaagacctaaaacgttaatcacctacatactttggaaagagaaaattatactattattttcatctaatggaaagtttgaagatttcttcaaagtgcaggaaaaaactttaactgggcatggtggctcatgcccattatcccagcactttgggaggccaaggagggaggattgtttgaggccaggaagacctgcgtaatgcagtgagaccctgtctctacaaaaaaaatccccaaaattgggtgtgttggcatgtatacctgtagtcccagctactcgggagactgaggtgggaggatcacctgagcccaggaagtcgagactgcagtgaactatgattgtgccagtacactccaacctggaggacaggttgagggctgtttcaaaaaaaaagaaaacaatagaaaagcaaaaaaaattatctggcacatgagaatatacttattaacatatatattatttttaattactaagaacagattagtgattctaaatcagggtttcttaacctgagatcactggttaagaatctagggtatgtggtttcaaggaggaagaaaatacatactcagtttcattactctttactggaaatttagtatcttcttccattatgaatgtaggctactaccatgtaggattaagaatgcctaggagtttgccatcagtagaagtcaaagggtgttaaaaaatattctgttgttgttgcagatatctctaaatacttgtttacacacataattacaaggacttgctaatttattaataaagagatatatgtacattatcacaaaggtctccctttgttgcccaggctgttctcaaactcctgtctttaagcgatcctcctgccttagcctcctgagtagctgggattacagaaataatgttttgacaattatgtatatataatggtttatctttgtaacatgttataatagtatgcatattagtttgctagggcgccttaacaaagtaccacagaggaggttgcttaaaccatagaaatgtatgtctcagggttctggaggctagaagcttgagatcacgatgtcagcagggccatgctcactcagaagatactaggaagagatctgttccaggtctttctcctggcttcttgtagctccttggcttgtggcagcatgaatccagtcttcacatggcactcttcctgtctgtatgtctatctgtacccaaatttcctgtttataaggacgtcagtcctataggattagtggcccacagtacttcagtatgacctcatcttgatacatctgcagtaactctgtttccaaataaggtcacattctgagttattgagggccaggatataaacgtgcatttggagggaggacacagttcaacccataacagtctgtaatactatgcatttatcagactgccagagggttccattctgcaaggaatttggcagactgtacagtcggagggcacagtcctccacaaaactgctgccctcacttcagacatcagcgacaatattgggggtccacaggatgactccagaccaactgtctacaaatttgggggcccccaccaccactcttaggtatgataagttactagaagtactgagaactcattgaaacctcttatagtcacatttattctagagaaagaatgcaaaataaaatcagcagaaggaataggtgcacagggcagagtctgggaggctctgaacatccagcattattgtgggacagtacacattgaggtcgagtatcaccaaccagggaagtctctggtatctagggtttttattggggcttgatcacgtactgccctcttggctgaccttttgtctccagtccttactggagatttgagctaatgccctttagtctctagttcctccagaggtcggaactgatgctccatgtcccacagccttgactgtccagtgatcaaagcctccaggcaaacaaagatattcccaatacgcagtgcattccaagggcctaaacatcactaccaagttgctgagggcaaaggccagacctctcttttggtataattataatttgagaacagatattccatggctcaaaagttttaaaaacttttgttctgaaggtatggtttaggttgcactgagctgagatcataccactgcattccagcttgggcgacagagtgtgactctgcctcaaaaaactaaaactaaaaataaataaaaaaagatatgctttcaacttaaaatagttttttctgcctaccaacaaatgaccattttctttttaaatggagttactgcatttacttaaatttattcagtttccataaaggaagaatgaagaatttcatagataacattttcttcctctttagaattttctaagaatagaattgaagaagtcacctttctataatttgctgccatttttttgtttcctcttagatgtttaaagttttatagctaaagttagaattctgctttaacaacacagatgacctagttctatctaatttattttcaagacaacaacttgttactgagcctatcttgcaagtataacaattgagaatcctcttttttacatttttggtagtctgttttatctgacatttgtattcagttaagtgaatacaggtttgttgttgttgttgttgttgttgtttgagacaaggtctcagtctgtcacccaggctggagtgaagtgacatgatcatggcttgctgcagccttgacctcctgggctcaagcaatcctcctgcctcagcctcccaagtagcttggactataggcatgggccaccacacccagctttttttttttttttttttttgggtagagacggtgtctctatgttgcccaggctggtgggaagttgttgccaaacacacaaactgaaatacttgattaaaagatgtcctggcagtatgtaggaaatacttttggaagacctaaagagaacgatcaatctatagttgtagtaggagtaataacaattacaacttgggctcactgtcactttttacctgtctcatttgttcctcatctagtctcatagacattgttgtctctgttttatggacaaagaacctaaagtttagagagattaagcagcttgtctagggtcacaagagttttcaaggtataaagataggtattaaggaggtggcatggaatacttcataaataacatattaggccttgtgtagtgtctcaacatctgtaatcccagtgctttgagaggccaaaataggaggatcacttccggtcaggagttcaagaccagcctggggaacatagtgagaccagtctctacataaaattttataatttaaccgggtgtggtggtatacaactgtagtcctagctactagggaggctgaggtgggaggattgcttgaacccaggagtttgaggctgcagtgaactatgatcatgccactgcactccaccctgggcagcagagtgagattctttctcttaaaagaatctttttttgagttgccttagtagaaaaacagtagatagataatatgggacaaaaggaaaggcttcatttggaggtgtggcagatcatatcttatttaaggaagtgctgagtggcctacactgtgaaatcatgggattcatgaaagggagttagaggtttgggtgcaaagggaacattgaggccagcgtatagaggctgagtgaatgccatatgaagaactttagatcttaatcattggtaatggtggaacagtgatagtactttacagagataactaatttaaataagatctctgttttaggatgatactctgttagcagtatcagtataagagcaggcctagagtgagatcagataaggaaaacgagttaggtggctgttcaaaaaatgcagaagatggctgggcgcagtggctcacgcctgtaattccagcaccttggaaggctgaggtgggaggatcacaaggtcaggagttcaaacccagcctggccaacatggtgaaaccctgtctctactaaaaatacaaaaattagctgggcgtgggcgtggtggcaggcgcctgtagtcccagctgaggctgaggcaggagaatcgcttgaacctgggaggtggaggttgcagtgagccaagatatcgtgcccctgcactccagcctgggcgacagtgagactccatctataaaaaaaaaaaaaaaaaaaaaaaagcaggagagaaacaaagccagagaaaggatggtgttggggattggaaatagagatgaacgtgaagatttctaaggcagaatggttagaacttggttaacaaaatgtttaggatgagtcattagctaatggggaacataagccaagtagacggcagaagacttgagttgtgtttgatggactttgagtttaacctgtttgtaggatgtccacatagagatgtctagtatacaactgaattactgaactgaatggttttctaaaagatttctgctatgtttattgacatttgtagcttctgtacttggcaaacaagcaactctttaatatttttgtttatgttttttcctgtgtttcgtagtcaattaaatgaaaagcccttacctgaaggttgggaaatgagattcacagtggatggaattccatattttgtggaccacaatagaagaactaccacctatatagatccccgcacaggaaaatctgccctgtaagttttctaaacattgtagattaagagtaaaatactagtccttcagattttgatataaagatttgtattagcaaggagtggaagtcttagtatttcttgagttagcttgacaataggtttctgttcattaagtattttgcatttccatctccctcttggatattttatcctagagattttcatatttgttaccatttgttcacacagcactaaatgaaactatttagaatttataggtattgtactgcttaccaattagtctctgatttctgattttcagcttctttcattcccttaactttttgacgttaaaaaagctctcattacttatcccccaccccatttctgagaaagtaaccttttgatttgcttatgtgctttatgacttcttttgtgggaaaatatataacctaaagtttcttgttttatgtgtacagttcagtggcattaagcacattcatattgtggcataatcattaccaccatccatctccagaatgttttcatcattccacactgaaacactgtaccctttaaacaataactttagcagacctggtaaccagccttctactgtctttctctatgaatttgactagtcgaagtacctcatattattggagtcatacaatatttatgcttatgtttctggattatttcactaaggtcatatcttcaagatttatccgtgttgtaatatgtatcaacattttcattccttattgaagctgaataatattccagtgtatgtatatatcacattttgtttattcacagatatttgcattgtttctgttttttggggggtattgtaaataatgctgctctgaacattggtatataattttctgcttgaggccgggcgcagtggctcatgcctgtaatcccagcgctttgggaggccaaggcaggcggatcacctgatatcaggagttggagaccagtctggtcaacatggcaaaaccccatctctactaaaaatacaaaaattagctgggcatggtggcgcacacctgtaatcccggctactcgggagtgtgaggcaggagaatcgcttgaacccaggaggcagaggttgcagtgagtcaagatcatgccacagcactccagcctgggtgacagagtgagactccgtctcaaaaaaacaccaaaaaccaagtatctgtttgagttcctacttcgatgacttttgtatctgtacccaaaagttagggttagggttagggttaggatgacttttgtatctattgctggattaaatattaattctgtatttaattttttgaagaaccaccatactgtttttcagtgtctgtgccagtttacatttccaccctagtgcagaagaattccaatttctgtacgttctcatcaactcttctgttttttttttcttcatcatcatcatatttttttttaaatagtcatccttaatgtcgtatttcattgtggtttttctttgtatttttctaatggtttgtgatgttgagtatcttttcatatgcttcttggctatttgtgtatcttctttggaaaaatgtctcttcaagtcctttgcccatttgttgttgttttttttttcttttgcgattgagttttaggtgttctctatatattctgggtgttaatcccttatcaaatacatgatttgcaattattttctcccattctgtggtttcctttttactgtagatagtgccctttgatgtataaaacattttagattttgatgtctgatttgtcaattttttcttttcttttcttttttgagacagtctctctctctgtcacccaggctggagtgcagtggcacaatctcggctcactgcaagctatgcctcccgggttcacgccattctcctgcctcagcctccgaagtagctgggcctacaggcgcccgccaccatgcccagctaatttttttttttttttttgtattttgtttaatagagacggggtttcaccacattagccaggatggtcttgatctcctgacctcgtgatccacccacctcagtctcccaaagtgctgggattacaggcgtgagccaccgtgcccggcctgttttttctttttttttttttctttctttctttcttttttttttttgagacggagcttcactctttttgcccactctttttgcccaggagtgcaatggtgcgatctcggctcaccacaacttctgcctcctgggttcaagctattctcctgcttcagcctcccgagtcgctgggattataggcatgcaccaccacgctgagctaattttgtatttttagtagaagacagggtttctccttgttggtcaggctgatctcgaactcccgacctcaggtgatccgcccgcctcagcctcctgaagtgttgggattacagatgtgaagctccgcgcccagcctgtcagttttttctttgtcacctgtacctttggtgtcatatccaagaaatcatttccaaatccagtgtcataaagctttgccctaagttctttttttttttgtagatagagtctcactctgtcgcccaggctggagtgcagtggcaagatctcagctcactgcaacctctaccgcctgggttgaagcgattcttttgcctcagcctcctgagtagctggggttttagctacgcaccaacacgcctggctaattttcgtatttttagtagagacggggtttcaccatgttggtcaggctggtctcaaactcctgacctcgtgatccacaccccctcagcctcccaaagagtagggattacaggcatgagccaccgcgcctggcctgagagttctttaattttagctcttacatttagatcttttatccattttaagttaaattttgtatatggtgttgggtaagggtccaacttcatctttttgaatgtgaatgtccaattttcccaagcaccatttgttgaaaagactgtcctttccccattgcatgactgtggcaccattgtcaatagcattttaccatatatgcaagggattatttctgggctgtttattctgttggtctgtatgtctgatttgccaataccacgctatagctttgtagcaagttttcaaatcaggaaggtatgtgtcctccaactttgttctttttttcaagctgcttttgactattcagggtcctttgagattccatatgaattttaggatggatttttttatttctgaaaaaaagaagtcatttggattttgataggggattttattgaatgtacagaatcaataaaatccatattgatcaatacagattcaatatctgtatcaatctggggtagtgtggtcatcttaacaatattaagtcttccaatccatgaatgtggatatctttgtgttttctttgatttctttcagcagtgttttgtggttttcagtgtacgagtcttttgccttcttgattaattcctaagtattttttattctttgtgatgctattgtaaatggaattgttatcttaattttctttttatattgtttattcttagtatatagaaatggaactattttgtgttgactttgtatgctgctactttcctgaattcacttactctggcagggtttttcgttgtggaatatttagtgttttcttcgtaaaagatcttagcttctgaaaacagataagttttcttcttcccaatttgggtatcttttatttatttatttatttttcttgcttaattcctctggctagagcttctggatactatgttgactacaagtggtgaaaataggcattcttatattgttcctcatcttaaagaaaaaacttctaaccattgaatgtgatgtttgctgttagatttttatatgtgccttttattatattgaggtagtttccctctattcctagtgtttcctatccctgttgtggagtgttttatcatgaaagtgtattaaattttgtaaaatccttttttggtatcaattgagatgatcatgtgattttttccccccctcattctgttaatgtggtatattatgttgatttttcataggttgaaccttttttgcattccaggaataaatcctacttagtcaaaaggattaaagtgtgcttttaatatgctgctgagatttttttgctgatttttttttagtatttttccatcagtgttcataaggaatgttgctctgtagttttcttatagtgtggctttcttagagcaaagatggttccctattactttctaattttatacttctacacattaacaacttttatatttaaagcagaaactggaaaatcaggccaatttggtattaatgaaattacagaggtaatttagatatgggaataaattaccgataatattattctatcattcattttagttacaataagtttgggtgcatataatagaaaacactaaaataatagtggtttatgtaagatagaagtgtatttgtccccattatttaaaaatagtccagcaggacttacaccacatcattaccattgctcaaaaaagaagttacaagaaaaatcaggaaatattttattttgaataataattaaaacaccacatatcacaatttgtgggatttaactaaagtagtcttcagcgggaaacttttgttttaaagaagtagatgagaatataggaaagataaaatcagtgatctctgcttttacattcagatgctagaaaaaggcaagttattaaacctaaagtaagtacaagaaaggaaataaataaaagcagaactcagtgaagtggaaaagaaacaatggagcgcccaaagctagaagataaatttttggtaaacattaataatattaacaacccttagtaattaaacctatagagaaaaaaagagggacatcactgtatattttatagacattaaaaggataataaagggtatatttatgccaataactttaacattttagatcaaatggacaaattctttgaaagatatgtcaccaaaatggacacaagaacagatagtaagtctaaatatccctatagctgataaatcaaatgcataattaaataatttttaagggcaggcccagtggctcatgccagtaatctcagcactttgggaggccaaggtgggcagatcacttgagctcaagagttcaagaccagcctaggcaacatggtgaaacccatgtctacaaaaaatacaaaatattagctgggtgtggtggtgcatgcctgtagtcccagttacttaggagggtgagatgggaagattgcttgagcccaggaagctgtggtgaaccgagatcgcgccactgtacttgagcctgggtggcagagtgtgaccctgtctcaaaaaaaaaaaaaaagaaaaaaaagatttctcatgaagaaaattctggcctagatggtgtcactggtaaggttcatcaaacttataagttataaattaatcagtcctattcaaattcattcataaaatacaagtgatggaaatgttttctttttcattttttttttttttttttttttttgagacggagtttcactcttgttgcccaggctggagtgcaatagcccaatctcggctcaccgcaacctcggcctccctggttcaagcaattctcctgcctcagcctcctgattagctgggattataggcatgcgccaccatgcctggctaattttgtatttttagtagagatgaggtttcaggccactgcattccaccctgggtgacagagtgacattccatgtcaaaacaaacaaaattggttaaaggagaaaaatcatacgataatttcaggaaaagcttgtgacataatacaatgcaaatttatgagaaactctcagctaccttggaaacttttttttttttttttttgagacggagtctcactttgtcgcccaggctggagtgcagtggcacaatctcagctcactgcaagctctgcctcccgggttcacgccattctcttgccttagcctcctgagtagctgggactacagacgcccgccaccacacctggctaattttttgtatttttagtagagacggggtttcactgtgttagccaggatgttctcaatctcctgacctcatgatccacctgccttggcctcccaaagtgctgggattacaggcgtgagctgctgcgccctgccggaaacatttttattggaaaaaaaaaatgtaacaaaagcttacagccaacatcacaattaatgatgaaataccgtagaacatcaagagtaagacaaggatatctactgtcattacttcattcaacattgtgtcagtattcctacccagtgcagtgagatgagaaaaagaaatacaggccgggcatggtggctcacgcctgtaatcccagcactttgggaggcccaggcaggcagatcacttgaggccaggagtttgagaccagcctggccaacatggctaaaccccgtctctactaaaaatacaaaaattagtcagtcatggtggtgggcacctgtaatcccagctactcaggaggcggaggcaggagaatcgcttgaacctctgggtcagaggttacagtgagcagagattgcgccactgcactccagcctgggagacagagcaagactccatctcaaaaaaaaaaagaaagaaaagaaaagaaatataagatgtataaattggaaaggaagaagtaaaactgtctcttttcccctcacacaaataacgtttgtatacagaaaatcatgaagaatctagaaaaaattactagaactagtaagtgaatttaacagcgtaacagaatataaagtcaatgtacaaaatcagttgtatttctacactgatatacattgaatttttaagagggagataatgcagtggtattaagtccaaggctagctgagaaaccccatggtgtcatagtgatctaaaattcttctgtcttttctaccatcctagagtatggtctcattcttcaaagtgacctcatggtctgtgacagctgctgaaacttaagctatcagggtcacactccaggctggaatttggaggaagggcaaattataaacacacacacacacacacacacacacactcacacactttttagctattttagctgtcttttagaaaatccttcctttttttttttagacggagtctagctttgtcacccttgctggagtgcagtggtgcaatctcagctcactgcagccttgacctctgaggttcaagtgattctcctgcctcagcctcccaagtagatgggattagaggcacctgccaccacacccggctaatttttataatttttagtagagacagagtttcaacatgttggtcaggctggtctcaaactcctgacctcagatgatccacccgcctcagcctcccaaagtgctgggatttataggtgtgaaccactgcacctggccaaaaagatccttcttgaacgtttcatatgccactttcacttagagacttaagtcacatggccatatagagaaatgtagtctttattatatgtagcattctacttagttaaatagcaagggttttacttaaagataaaggagggaattgatgttgggatagacagcattctcagatagaaacccctttacttagccctcttagatttggcagcatagaaaagaaaatcccacaacagtagtttcaacaaaatcaaagttttttgtttgttttttctgttacttaaaagtattcttggggaaatatctctcaaaaagcaaagaatggttttgttaggaatatgctatatttttgaatttggttagtaagtgctgagagagggtgggatattttgctttccttcagcattatcttttacaagcagctatatatgtcctgttaacccttgttcttcctcagagacaatggacctcagatagcctatgttcgggacttcaaagcaaaggttcagtatttccggttctggtgtcaggttagtattggaactgtatctctgtactgccttaactttgttgtgttgctttatattacacagtgattgtgaaaatacttaactcacagaaaaacaggtaaaatgggaagcattagaatctctttcatctatttttagagcaaataaatagatttatcaattagatcatttgtgactttggttattcagaaaattaaacctcatgtaatcccagcacttggggaggccgaggtgggcagatcacttgagctcaggagttcaggaccagtctgggcaacatattgaggccttacctctgtaaatatatatatatatatatttcttttttttaaagaagaaaattaaacttgaaaccatctgaataagcaaacattgtcactttttcctcagtagccattactttcagattgcaggaatcttcaaatgtaagtaaaagcattttctgatataattttaaccagctactttatttttatgtgttattttttctgagacaggatctcactctgtcacccaggctggagtgcagtggtgccatcatggcttactgcagccttgacctcctgggctcaagtgatcctcttgcctcagccttctcgctagctgacactacagatgcacttcaccacacctggctaatttttagtagagacagggtccccttatgttgcccaggctggttttgaactcctggattcaaatgatcctcctgcctcatcttccccaagtgctgggattacaggcataaaccagcatgcccggacaccagccatttttatatctatcgtttgatataactgactttgatagataaatacatgttcatacatacatgaacatgtccatacatagatgttatattcagtgtttttttcagatgtgatcaactatttcttatgtatagatatttactggaattaatgattttttatgggttctaaatcaaatgaatgccctagtcaaagttactgtgatgaatatttttacacttgaaactcttgtaattaactggacccatggaagcaagaagaatctggattaactgttggaaaataagattaagtaaagatttatttgacacattattaagtaagcagtgtgcatatgagatcaatcttgtggttcttctgtttgcatatattaatctgtaattagcatgaatactcacagatgcattggtaaacattattgaatataaatttatattcatagtctacttgtttctgtaaggaaagataaaagtaaataaaactttccccttttgatttttttgataggctattttaatgatgagagttgacttaagtcattcttctatttcagcaactggccatgccacagcacataaagattacagtgacaagaaaaacattgtttgaggattcctttcaacaggtactgtttcattctctcaataatttcccccctggctgctagcttaggacccgcttttggtgctgtcagtttaatctgaatggtttggaacttcttgagttgaagtccttgaatttttcaagtgcgatctcattgccagccaccttagggcttaaggggtgtgtgtgtgtgtgtgtgtgtgtgtgtgtgtgtgtgtgtgtttcaggtttccatttctaaactggtatgatttgaaataaatgcataggtaagataataggtttgtgtgtgtgtgtgtgtgtttcaggtttccatttctaaactggtatgatttgaaataaatgcataggtaagataataggtttttggtagccaaaggtctggaaatacccatatgaacattatcagattgtagaaaggagaggggaagacttgttttaacacttcagtattacttggatttttacaataagcgtatgttactcttaacaggaaaaaaagtggtcattggtgacagtatctaaaaaaagatatatatgagttttcagaagtagtcagcagattttttcacttgtcttcagaacttgagttaatttactcgctgggcacggtggctcatgcctgtaatcccagcactttgggaggctgaggcgggtacatcacctgaggtcaggagtttgagaccagcctggccaagatggtgaaaccttgtctctattaaaaatataaaaattagctgggcctggtggctgatgcctgtaatcctgtaaagctactcaggagagtcacctgaacctgggaggtggaggttgcagtgacccgagatcgtgccattgcattccagcctgggcaataagagcaaaactccatctcaatttaaaaaaaaaaaaaaaaaaaaaaaaacttgagttagtctactattcgcctttatcttgcagatattactaataacctactgcaactaaatgttaaaatgattgtgttatgtagaagattaaaataactagtgaaaaaatgtcttaaaatgaaaacatctggttagtccttgttttatagccagatgtggaagtgattattttcaagcaccagtggtattgtagcaactacagcttcaagaagtacggaattgaatgcaaagggaaaagaggttgagacagttggtggtagctggctacttgctttcagaatcagtttttttcatttcctaatggaacgtcagttattgacattaaaggaaaaagccagttggcatcctgctatgtaggagcagaaaactttttagtgggaagtggagctttactgaggccatttagagaattatgagtcatccccttgatctgatgtaagtgtcacaggccattccccaccctagtccttgcccatttctaattttatgttcataaccacccttttatcactctgttggacgagtttcttgaagcaacttgcttacctcttaccagtcctggaaagatgcaaaacatgattaaactgttcctttatcttttgactttgaaacctaaagtcttttgcaaaataactgactagatggttctaaaacagtttttaaagctgtcaccctagatttgacatccatcaaataactggttaataaaaatataagagaacaatttgattgcttaaaggtaacaaaactaattgcaaaattagcatcagattttctttggatagttgttggataaaattgctctgggatagtgtttcttctgttaacacagcacaactggttatgggggaaagtacaggagaaaacaattttttttccttcatattagacatttgttaaaaggaatttttttttaacttttatggatttatttatagtaaagataaggatacaaatgtcttccacacatatgtggtaatctgtggtgctcgccactccctccctcctgggactgacacactgcagcccacgctgctcaccctggagccccatccttgcatgagagaatggcgccacctggggctgtgcgacctgtcagcctgctcattcccttctccagctcaggacagagaaacacaattcattcataaggtttccattctgttataggcagagatttagaaatcagcattgtttttcaaagagtacaaagttaaaccattctgcttagaaaagaataaacccatccaatcatttttcctctagttgagtcaaaacagagatcaaacttctttgatagtgttatgtctgtgttcagacttagacttcagaatcaaaattttgaaatatttatgaggttaataactatctttgaagttaagcagtttactgagcaattaaatatttttgtccatacacattcagatttaactactgctataaattgtcgtaatttctccagtttcagtctgaacataatagcttatagtaataagacacaggttctagtacagattttccaattagtggtatggccctaaacaagccaggttagatctctgccttcacctacatcaaacaggaataataatatatttccttaacctatcttctaggtaaacagatgagattatatgaaaacattttgctaaagtcgctaaacaaacataagaaaaaatatgtaaggtttttctatcacattaactattttttaatatctgactgacatttttgtaatataaccaaaataaaaattgcatactttcttttttttttcttttattgatcattcttgggtgtttctcgcagagggggatttggcagggtcataggacaatagtggagggaaggtcagcagataaacaagtgaacaaaggtccctagttctcctaggcagaggaccctgcggccttccgcagtgtttgtgtccctgggtacttgagattagggagtggtgatgactcttaacgagcatgctgtcttcaagcatctgtttaacaaagcacatcttgcaccgcccttaatccatttaaccatgagtggacgcagcacatgtttcagagagcacagggttgggggtaaggtcacagatcaacaggatcccaaggcagaagaattattcttagtacagaacaaaatgaaaagtctcccatgtatacttctttctgcacagacacggcaaccatccgatttctcaatcctttacccacccttccccgctttctattccacaaaaccgccattgtcatcatggcccgttctcaatgagctgttgggtacacctcccagacggggtggtggcctggcagaggggctcctcacttcccagtaggggcggccgggcagaggcaccccgcacctccaggacagggcggctggccgggcgggggggctgacccccccacctccctcccggacagggtggctgccgggtggagacgctcctcacttcccagacggggcggctgccgggcggaggggctcctcacttctcagacggggcggttgccaggcagagggtctcctcacttctcagacggggtggctgggcagagatgctcctcacctcccagacggggtcgcggctgggcagaggcgctcctcacatcccagacggggcggcggggcagaggcgctccccacatcccagaccatgggcggccgggcagagacgctcctcacttcctagatgtgatggcggccgggaagaggcgctcctcactcctagatgggatggcggccgggcagagacgctcctcactttccagactgggcagccaggcagaggggctcctcacatcccagacgatgggcggccaggcagagatgctcctcacttcccagacgtggtggcggccgggcagaggctgcaatctcggcactttgggaggccaaggcaggcggctgggaggtggaggttgtagctagccgagatcacgccactgcactccagcctgggcaccattgagcactgagtgaacgagactccgtctgcaatcccggcacctcgggaggccaaggctggcggatcactcgcggttaggagctggagaccggcccggccaacacatcgaaatcccgtctccaccaaaaaaatacgaaaaccagtcaggcgtggcggcgcgtgcctgcaatcgtaggcactgggcaggctgaggcaggagaatcaggcagggaggttgcagtgagccgagatggcagcagtacagtccagcttcggctcggcatcagagggagaccgtggaaagagagggagagcgagaccgtggggagagggagacgggagaggcagaggcaggggcaggggcaggggcaggggcaggggcaggcagaggcaggcagaggcagaggcagagctgcatactttcaagaatgacaaaatttagtagttatacaaggtgaattaaaatagtaaagctagtcataatacagaatccactcatccatgtactcattttatcacttaaataataattataaaaataggtaaaattccatgaaaatattcctatttgttctagttcaggaggtcttgcccacatcaatggattgtctggcatcagccactgtttcaggcactcgaacagtcatattgtccatagattttgtcaaacagatttggcagcccaactgtgatctgttagtccatatgccagatcgagcatgtgattctcctcatcagtgattgcatctaacttctcatatatgtgatcttcaaagatgagatgacaggttaaacaagccagagttccctcacatgcaccaaagccatcaatatctggattattttcaaccacaacgtctagcagagaatcaccaacttttcctttggttgttaatgtttcaccatcacagtttataaagtggactgtcactttatcttctgagctgctccgcgcccctgccgacacgctcagcggccggctcgcctccgcgctccggcccggtccccggctcctcagcaggccgctggctccagcgcgggacccggcgtggtgcagccaccggccggccgggtcgccgaggaccgcagaagcggcgcgcagcagccgggcgcccccagcggcagccatcgcccgcggtcgggaactcaaaaggaattatttaaagatagttttaaccttgtgacatttctcatttgcgttgctgtatacctagcctatactatttgtagaatacttggcataaacgtacatatgtcataagcattgaagttttttgttacatctgggattttctggcttgagtgggatgtgaattcataaatgtgatggttttgtgggggaactgagagaacttggcataaacaggtatacttactgatcctctctggatatttaagtgtggtaattcattcttatcactcaataaagtataggcattatatcaacttctccctttccatgttcttctgtatttttttgtaagagtaattgatatatgcagtgctatacacacacaattttggtcaaataatttgttttacgtggcaggaaaccaaatgacctattgattgtagctcagtaatgtactgtccttcaaatatgaagatgatcctattaaccacctatagtgggacacaaaatttgagtagtttttgtaggtagttatcggttgccgctgagaatgagtttccaaagttaactgggtctctctgcagctactggttttcatttctcggttagccagttagctgttacgtgtacctttggctatgagtcaaaaccaaacctaataaccaaaccacaaaaaccccacccaacctctgaccatgcccatctatgttctaagtaattgatacaggcaacattataagtcaatagtagcatcattaaaaataaaatcacggccgggcatgatggctcacgtctgtaatcccagcactttgggaggccaaggccggtggatcacctgaggtcaggagtttgagaccagcctggccaacatggcaaaaccccgtctctactaaaaatacaaaattagccgggcgtggtggcgcacacctgtagttccagctacttgggaggctaaggcaagagaatcgcttgaacctgggaggtggaggtgtggtaagccgagattgtgccattgcactccagcctgggcaacgagggagagactgtctaaaagtaaataaataaataaaatcacgtgtataaggtatataaaaatatagatgtatataataaaatattattaaacgttactataatgtattttctgtatgtgtggttttgactagaccatgaacacctttctgtgtcatgggagatttcagttacctataacgaaggagatgtcaaacctagaagtggtagacagtgtttcaatagcttttttcaccaattattttactttatttttttttagataatgagcttcagtccccaagatctgcgaagacgtttgtgggtgatttttccaggagaagaaggtttagattatggaggtgtagcaaggtagtgataatatgaatactcagaacttagttcctttcctccaaaggtaccattgcacttcgcttgcaagtattattttctcaatcttatattttaggaaaatgaaatatgtcaaattattatacctttattatgctgtagctacagaatttcaaaaaacatttaattcagcactttctatgtcatgtacagctgattgatttcacccacatcactcatttaatcttcagggtaaccttgtgatacagaattttataggatgatgaagaggcttagagactcacctaaggcacataataaattgtagagcctggatgcaagctttgtatcatttaaccagtagccagtgttaagtctaccacctcttatatctgttccacagaaaacacaaggccttatagtgatcaggtcattttccccaccacagattactgatacaggtaatagttactcagtttccaactgagattagtatatttgtcatgaaaatatagaaggttgtacaaaataggagttgaaagtcttaattctgctttcttcatattggagcttaatattggaccctagaagatagtctctaatgagaattgctttgcttattccatgataatatatcacaccaggttaaaaatttgcgtagagctggcattgtgcaaagacaaggactttggggtcaagacgggatttgaatctttttctgctctcaatagtgtgatgttgggcaaatattttcatctgtaaaataagaatattaatatctacatttctaggattattgtgaagagtagaaatattgtttattaatgacctagttcagagcctgtgtctttgtgtgcacgctaattggtggctacattttagtagttcttatttatattatgtttctgagtttaaataaaattatttcaaaatatatgatataatcatagataaataacaaatatgagtagaaacatgtaattttgtataagttaaaggcaattgaagaggagagcaatcattcattcctaataagaaaataaactagcaatattaaagtgtgtcatgagatacacttatcacaagaggccatgaactaacaggaaaagagatccagattacaggcttatgccacatgtattaccccagatcacccatgttacgtagttttagtaaccataatcttatgttaatattggttcatattttcacaatatttgacttagagtctcagcatttttctaatatgtgagtggctggaattaagaactttactgcctctgtgaaattggaagaattttcatattgatttaacgtgtagggagtagtggcacttgatggggattattatgggacttagtaatagatggaatattagattgatttcagccactttactcacatgggtaaatagtgaattttaaatttgcctatgaatagtatttcattgattctaagactaatattttcattttataatatctctgaaattacgatgtatctcaggtaaaattggaaaatacaatttagtcgttcatcaaataaaggtgcaatgttgtcttagattttttgaaatgtaataatgtatatattaccatctaccaaagatggtgtatactaccaactctgtgaaacagatgtgagtttgaacagaagcaataaaaatcaacatgagattagaaaactatcactagctgaggggtatagatccctgagaactttatagcactgttctttgatttcttggtaacctacaagatttttcatcgtaaattttcttttgatttcagagaatggttctttcttttgtcacatgaagtgttgaacccaatgtattgcctgtttgaatatgcagggaaggataactactgcttgcagataaaccccgcttcttacatcaatccagatcacctgaaatattttcgttttattggcagatttattgccatggtaagtgcaggtcaagaattatgtttactttgcttattcagcaatactaaattttctcttaggtgccataacagatcatatgagagaaagggaagtggttttttgttttgttttgttttttatttttgagacagagtcttgctctgtcacccaggctggagtacagtgacacgatcttggctcactgcaacctctgcttcctggactcagtcagttctcccgcctcagcctcccaagtagctaggattacaggtgtgcgccaccatgcctggctaatttttgtatttttagtagagaaggggttttgctatgttggccaggctggtcttgaactcctgacctcaggtaatccacctgcctcagccttccaaagtgctgggattacaggtataagtcaccgtgcccagccagggaagtgtttttttgagacaaagtttcacttttgttgcccaggctagagtgcaatggcgtgatctcggcccaccacaacctctgcctcccaggttcgagcaattctcctgcctcagcctcccgagtagctgggattacaaacaagcatgtgccaccatgtccggctaatttttgtgtttttagtagagatggggtttctccatgttggtcagtctggtctcgaactcctgacctcaggtgatccacccacctcggcctcccagattgctgggattacaggcgtgagccaccatgcctgacccagggaagtgtttttaaatgaagagtacatctaatatattgaaataaaatgattattgtacagttattttaagcggtcttgtttccttttttcataggctctgttccatgggaaattcatagacacgggtttttctttaccattctataagcgtatcttgaacaaaccagttggactcaaggatttagaatctattgatccagaattttacaattctctcatctgggttaagtaagtttctttttccatgtaatttattaaaatatagttatatgcattccgtgtagtattgataacttatccaaactgtaggcacataattggtttattgtatttaaatgatctatatatcaaacctgtctttttattcaatatgataaattttacaaaaatacacccaagatcttcggcaataatatgaccttagaacagaatcttatttcttcttattttgatgttatagcttaatattaattatttaagaacatgggcctttcgttaaaaacttataaattatgattgaattggtggatataacaaatagtgctaatttcatttgtgcagggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcaggtgagagtgctccttttcacatttcactttttgtttgactacagcacattgataattgcttactaatactaatggagagtatctccaaaaatagtatttgtctctgtactaatcaatatcctatgtaggcagtcatttttcatttctaaaaagtttttttttaagtgtttttaaaagagttttaaggataaaagtcatgcaggatcactcttttaaacatcaactctgtaatcactatgctgtataacatgtcattaaaaagaatctcaaatatatatgcagatattttcatggggaatattgtaaggtgtattaatccactttcctgctgctgataaagacatatccaagactgggcaatttataaaaaaaagaggtttaatggacttacagttccacgagggtggggaggcctcaccctcatggtggaaggcaaggaggggcaagtcacatcttacatggatggcagcaggcaaagagagagcttgtacagggaaaactcctgtttttaaaacctcatcatcggccaggcatggtggctcatgcctgtaatcctagcactttggaaggccaaggcaggcagatcacaaggtcaggagattgagaccatcctggccaacatggtgaaaccccatctctactaaaaatacaaaaattagctgggtgtggtggcatgtgcctgtaatcccagctactagggaggctgaggcaggagaatggcttgaacctgggaggcggggattgcagtgagccaggatagcaccactgcactccagcctggtaacagagcaagactctgtctcaaaacaaacaaacgaatgaacaaaacacttcatcatatcttgtgagacatattcactgtcatgcaaacagcaggggaaagacccacccccgtgatcccatgattcagttatctcactgattctctcttacaacacatgggaattatgggagctacaaggtgagatttgggtgaggacacagagccaaaccatatcattctgcccctagcccctcccaaatctcatgtcttcacatttcaaaaccaatcatgccttctcaacagtccccaaagtcttaacttatttcagcattaactcaaaagtccacagtccaaagtctcatctgggacaagggaagtcccttccgcctatgagcctgtaaaattaaaagcaacttagttacttcctacatacactcagggatacaggcattgggtaaatacagccattcaagatgggagaaattggccaaaacaaaggagctacaggccccatgcaagtttgaaatccagcagggcagtcaaatcttcaagttccaaaatgatctcttttgactccatgtctcatatgcaagtcaccctgatgtaagaggtggcctcccatggccttgggcaacactgcccttggggctttgcagggtatagccccccaccggctgctttcatgggctggcgttgagtgtctatggcttttccagtctcatgctgcaagctgttggtggatctaccattctggggtctagaggacggttgccctcttctcacagctccactaggcagtgccccagtagggactctgtatgggcctccaacttcacatttcccctccacactgacctagcagaggttctctgtgagtgccctgcccctgcaagcagacttttgcctgggcatctaggcatttccatacgtcttctgaaatctagagggaggttcccaagcctcaatttttgccttctgtgcaccctcaggctcaacagcacgtggaagctgccaactcctggggcttccaccttctgaagcaacaacccgggctgtaccttggccacttttagtcatgctggagcagctaggaaacagggcaccaagtccctagagtgcacacagcgtggggaccctgggcccggcccatgaaaccatttttagctcctaggcctgcctacaggcttgtgataggaggggcttccatgaagacctctgacgtgccctgtagacattttccacattgtcttggggattaacattcgggtcctcattacttatgcaaatttctgtagccagcttgaatttctcctcagaaaatgagattttcttgtctattgcattgttgggctgcaaattttccaaacttttatgctctgcttcccttacaaaactgaatgcctttaacagcacgcaagtctcctcttgaatgctttgctacgtagaaatttattccaccagataccctaaatcatctctctcaagtacaatcgtctctctcaagtacaaatccaccagtctctagcacaggggcaaaatgctgccagtctctttgctaaaacatacaaagagtcacctttgctgcatttcccaaaaagtttctcatttccatctgagaacacctcagcctggactttattgtccatattgctgtcagcattttggtcaaagccattcaacaagtctataggaagttccaaactttcccacattttcctgtcttcttctgagccctccaaactgttccaacgtctgcctgttacccagttctaaagttgcatccacattttcagttatcttcagcagcaccccactcctggtaacaatttactgttttcacactgctgctaagacatacttgagagtggacaatttacaaaagaaagaggtttaatggacttacagttccacatggctggggaggcctcacaatcatggtggaaggcaaggaggagcaaggcatgtcttacatgaatggcagccggcaaagagagagcttgtgctgggaaactcccattttaaaaccatcagatcttgtgagacttattcactataatgagaacaacatgagaaaggcccgcccccatgattcagttatctcccactggttctctcccataacacataggaattatgggagctacaagatgtgatttgggtggggacacagagccaaactatatcataaggttgggtaaaatttataactaaaatgatgttttatagtatatcctttctgattatttccattggttcatgctactagtctcaagagctaatagttcattcataccttctcaatagcaattctttccagccagggttaaattttgcatatttacttcttaagttccaggttctgcatttcttgcctggtttttccctccataattgaaagtatactatttaacacagtgagctgtcattatttcttggacaacaatctatccttttaaaagtttattttgaaatctgcttttaaaatgtagtcaattcgtttttgtcaattctccagtttttttgttatgatatgtctagattttcttatgacatatatagcattccagagaggtaatgtttcgagattccaagagatgtactacgtttctcaatagttttgttgctggtaagataacattttaagataatgggcagctaaaaaggtttttagtatctacttcaataatggcttgcttaaaatttcagagtttggggggtttttagtattattttaagaagtataatttccttagaataaaatgcactgatcttaagtgtagaagttgaaatttgacaaatatatatatcagcccaaatgtgagcattttatggagagaagttgtgctagatcactcatttaattaccaattctgtaaacactgttccatatagcatcatgtccatgtaaatatgacccaaattgtggaacttttttttctattctggaccccataaggggccaatgcacacctcccttctcccagccccagaggtaggtaaccatttctgtttagttctatttctataactgtttctgatcttaaacttcctaaaatgaaatcatagagtatgtactcttatatctagcttttagtgtctgattttttcttttatttggtgtttgtgagattcagccatattgtttatatcagtattttattcctttttattgctgagaaatattccatgctgtgtatatctcaaaatttgtttatccattctcttggtgataaatgttttggttgtttctcagtctggggcttttatgagtaaagctgctataaacattcttgtgatatctttttgtggacatatttttcttgagtaaatacctaggagtgaaatcgctgggaaggtgtttgactttattagaaactgccagtttcccaaagtgtttttgccattttgcagtcctactagtagtatttgagagttgcttcacgttcttgccaattcagcattgtcagtaatatctcgtggttttaatttccatttcttccttgactaatggtgtcaagtacgtttttctatgcatattgatcatttgtagctcttcttttgtgatgtgtgtatccaaatcttttatccattctaaaattgggttgtctttttatttgtgattgttggagttcttaaatatttcagatcattgattttagaaactcttctctttcccttcttccctccctcttcttaccttttcttacgatacgtctagatttcgttcttctttgacggagtcttgctctgttgccgaggctgaaatacagtggcacgatcagagctcactgcagtcttaaactcctgggatcaaaggatccccctgcctcatccttctgagtagctgggactgtaggcacaagccactgtgcccagcaaattttttggttgtttttatttttgtagagatgtggtcttgctattttgcacaggctggtctcagactccttgccttaagctatcctcccacattctgttttctaatataaggatttaaagctgcatatttccaactaagtatttctttagctatatcccacaattttttgttgttttttttgagatagagtctcactctgaggttgcccaggttggagcgtagtggtagagtcatggttcactgtagcctcaacctcctgagctccagatagcctcccacctcagccttccaggtagctggaaccacaggcatgtactaccatgcctggcttacttatttatttatttattgtaggagatgggtcttactatgttacccaggctggtctccaaactcctggatccaaacgatactcccactttggtctcccaaagtgctggaattataggcatgagccgccgcatccagtccacacctttttttttttttcccccgagacagagtcttgctctgtcgcccaggctggagtgcagcggtacaatcttggctcactgcaacttccatctcctgggttcaagtgattcttctgcctcagcctcccgagcagctgggattataggcacccgccaccacgcctggctaatttttgtatttttagtagagacggggttttgccatgttggccgggcttgtcttgaactcttgacctcaggtgatccgcctgcctcagcgtcccaaagtgcctggattacaggcatgagccaccacgcccagccacaaattttggaatgttgtgtttttcactattttatttattttatttatttatttatttattatgttttatttttattattaatatttttgagacagggtctcactttgtcacccaggctggagtgcagtggtgaaatcttgcctcacggcagcgtccaattccagaagttcaagcgatcctctagcctcagccaccaagcagctgggactacaggcatgtgccaccacacccacatgacgagatggggtttcaccgtgttgcccaggctggtcttgaactcctgtgctcaagggatccacccacctcagcctcccaaagtgctgggattacagatgtcagccaccacatccagccactctcattgtatttaaaagtatttgttaggtttttttttttttttttttgagacgtagtctctctgtcacccaggctggagtgcagtggtgccatcttggctcactctaagctccgctccctgggttcacgtcattctcctgcctcagcctccggagtagctgggactacaggcgcctgccaccacacctggctaatttttttgtatttttagtagagacagggtttcaccgtgttagccaggaaagtctcaatctcctgacctcgtgatcccctcacctcagcctcccgaagtgctgggattacaggcatgagccgccgtgcccagccaggtcttatttttatcctgataatctctactttataattggagtgttcagtacatttatgtttaattttattactgatttggttggacttttgtctaaccattgctatttgttttgctatttgtctcgccttgctatttgtttcttatttttcccaactttctttgttctttcttgccttctttgaataaagcaatttttactttcttttttagctcttctgttggttttttagctatacctctttgtttaactttagtggcaactctaatgattatgataatatgcatctttaacatccctgttgacccaaacactacttcttgtacaatataagaagctcataggccaggtgcggtggctcacacctgtaattccagcactttgggaggctgaggtgggcagattgcctgaggtcaggagttcgagaccagcctggccaacatgatgaaaccccgtctctactaaaaatacaaaaatcaactaggcatggtggcaggcacctgtaatcccagctacttgggaggctgaggcatgagaatcgcttgaacccaggtggcggaggttgcagtaagtcgagatcacgccattgcgcttcagcctaggggacaagagcgagacttcgtctcaaaaaaaaagaaaagaagctcataataatataattccatttacctcactccagctctttgtggtgttgttgtcatatattatttctacgtgtcacaaatataatactttgttactgttattcttgctttaatttttaactattttcaaaaataatcttatatttactcacattactatttctggttctccttatttctttcctcagattcatttttttttttaaatctaagataatttccctttggctttaaaaaaaaaaacctttctttaccatttcacttagtgtgcatctcttggtgatgcattttctcagcttttatatgaaaacatctttatttcaccttcattttttgaaggatattgtcactagatttagaattctaggtttataaaataatgatgcggtcatgtttttatgatttatgttttaaaaaataatcctcatgtcgtagagacaaatactgaagtatttgttcaaaatgaaattatctgggctgggcgtggtggttcgtgcctgtaatcccagcactttgggagaaggcaggcagaacacttaaggtcaggagttcaagaccagcctggccaacatgatgaaacccccgtctctactaaaaacacaaaaatcagttgggtgtggtggcgcacgcctgtaatgccagctactcgggaggctgatgcacaagaactgactgaacctggaaggtggaggctgcagtgagcccagattgtatcattgcactccagcctgagtgacagagcgcgaccctgtctcaaaaaacaaaaacaaaataaaagaaaaaaaaagaaattatatggcttggcaatggtggcacacgcttgtaatcgtagcactttggatggcggaggcaggaagatcacttgaggccagatatttaaaaccagccttggcatcacagagagacaccatctctacatacaaaaccaaaaatcagccaggcgtggtgttgcacacctatattcccagctactcgggaggccgaggtaggaggattgcttgagcccaggaggtcgagactgcagtgagccaagattgtgccactgtgcttcagctcaggtgacagagtgagacctcatctcaaataaataaagaaatgaaattatatgatatctagggtatgagtaggggcatagatgaaatagatgggcattgtgatgaagcttggacatgtgtacagggggttcattatgttctatttttgaatatattttaagttttttataattttttaaaatttatttttatactcagaatttaaagataagatctaaacttcctgataggttttttcatatttgtttgccagaatggtagctgagtggaggttgtctcgaggtgttgaagaacagacacaagctttctttgaaggctttaatgaaattcttccccagcaatatttgcaatactttgatgcaaaggaattagaggtaatgaattttccttcattcccctgtaccatgctagtaaataatgccttaagttgtctgcttttaactcactttcccatctttcctgttactgtaatatttttatactggggcaaaatgttttgaaacatccccaatggttaaagaaaatcataatttatccaaagataaaacaatagtattaccccctccaaagtacaaatattagagcttctctacaattgagtgacttacttccctgaatatgtatatgtatgacaccgtgcatggaaccttgccttcatgagcaatgtagatataattcttgatgtatagttgataagtcaaagcctactgattgttattctaaagctttgcttaatcttagtctttcctatgtccagctgtttttgtacagttaccttaggaaacaatttgtctttttcatccctaaaggtccttttatgtggaatgcaagagattgatttgaatgactggcaaagacatgccatctaccgtcattatgcaaggaccagcaaacaaatcatgtggttttggcaggtttgtttttaaatttatttctattagttgacacagcataattttttagaatttgcttaccacatatggaaatgagtcacaggtcaaaatgtaccagtgtatatagaccccttagtccatgcattataataaatgaatacagattataacagcatccttttaagactattgccaagtaagccacacataccttgcatctttgtccaaagtagagtgtaagacaattcgagatgataaaatttacctacatttgatttaaatggttttggggttttataggactgtctgtagtatgttttttatcatttatacttcattaattatataatgttcagaaggcaaaatttaagagacttggtttagaatcataacggtatctctctaaaaatgtctgccttaagcatggtatatgatgttcaacatcattagtcattagagaaatgcaaatcaaaaccacagtgaggctgggtgcggtggctcacacctgtaatcccagcactttgggaggctgaggcgggtggatcacgacatcaggagatcaagaccgtcctggctaacacggtgaaattagccgggcatggtggcacatgcctgtaatcccagctacttgggaggctgaggcaggagaatcacttgaacctggaaggcagaggttgcagtaagccaagttcgcactactgcactccagcctgggtgacagagcaagactctgtctcaaaaacaaaaacaacacaatgagataccacatcacacttagtattatttttgaagtggagaagaacaaccattgccaagggcgcattgctggtgatagtgtgaaataccacaccactgtggaaatagtttggtggttcctcaaaatttaagcatagaattaacataagatccaggaattccaatccttggtatacagcccaaaaaattgaaagcagagacttaaacagatacttgtacaccagtattcatcattcatttaccgacacaaaatgtggtatatgcatatacagatgctcctggacttggagttttatcctttatatccatcataagtcaaaaatatcttgagttgaaaatgcatttaatacccttatcataacttacccattgtaaagttacattgtaaagtcacaacttacccattgtaaagttgaaaaatcataaatcgaaccatcataagtctaggtgctcctcaacttatgatggagtaataaacccaataaacccatcataaagtcaaaaatttgtaagccagggactgtctgtgttggaatattattcagtgctaaaaagtaatgagatttttggtatgtgctacaacatgaacaaaccttaaaaacattatgaattttaagataagcgaagtaagccagacacaaacggacaaatactgtataattccacttacatgaggttactagaatgggcagcttcatagaggcaaaagtagaatatgggttaccagaagttgcagggagcaaaaatgggaagttgtgtttaatgtgtacataggttttacttgggatgatgaaaaagttggaaatagtggcgatggttgcacaacagtgtgaatgtacttaatgtcattgaattacactcaaaatggttaaaatcgagaatttatgttgtgtatattttacaaaaatttaaaaaattaaaaaaatctggtatacatgtaaaaaaattcatatgagaaacttaaactgagcttctataacaagtaggattacaattgtaggataattaataatactacaataggataaaaattattccttataaaaaagtttttggctgaggcaaaacagttatactacaggctagaaacattctctagaaacctattgttttgagtcagaattgtatgaaataaaaaccacataattctagctatgtgtagctataccaaaacctaaagaacattgagaagaggaggttattgggatatatcctgcatcagaattctgtgagtttgattaaagttgtttattaaaccaaaaagtctgtactgactcaaggtctgtatcctgtgtagccacatgaatatcctataggacgggcaaatctggggctggggggtggtggtgggatggggagtcacaggaagggctgccctagaagagctaatcttaaaactgcgtgagtacggagctcttggtctcagtccatcttactttttatatatccctttaagtatattgtcctaagatttatataaggaaaggttgatggggctttgataaacatggaaatggccctccatccatagtgttaagtaattatctaatgcagtggacaccagagtttcctttaagatttgaaatgagctagatacagtggcttgctcctatagtcccagctactctggaggccgaggcaggaggactgcctgctgcccaggagttagaggctgcaatcagctatgattgcatcactgcaccccagcctgggccacagagcctgggacacctcacctctaaaaaaaataaaagatttgaaatcattatttttctttcttgtttagtgtgctgaatgtaacatatgacatatatatctctttaaatatacttttaacagtttgttaaagaaattgataatgagaagagaatgagacttctgcagtttgttactggaacctgccgattgccagtaggaggatttgctgatctcatgggtatgtatacaggatcacttttcctatacagaaaattgtttatcatgctgctttacgtaaatgtgtatacagcctattagaaacaacaaagacagggatagccattttcttaactattcccagttagcatggatttgtataacctttaaaatagtttttagtacttacctttgtagaaatttttaaccctcaagctagaacccacagctaactcattaggacagcagtcttctgtatgtaaatctgttcatttagtcatttgccaaacatgtgtgtcttaagagtcaatcactattggttgtattatttaacgatgtgagaagatcattatataatacaatagtggattgtagttttagtattgtgtttaaaaccactcttccctgggagactgggagttctttgagaaatggattcatatcttcatctttttatttcttgcccctggcaaagtgcctgttacacagcaatctgctgcttaaaatgaatattaagatgaatgactatggcaatattcactttgttactaaacagtaaattatttaagtaaattcaagtatttccttaataccaacattatcccaagtatcataggaggatacacagagaagttaagatcccaaagcctgcttcagactgaagcagagagtcaaaattagaactaagcaggtaattttgaatacagaacatggaaccagtttagaaagtactttaaaagccagaaaaagaatttggatattaccgtgagggtattggaagctgtggaactttttgaagagaggaaaacttgctcaagctgcatttaggaagatttgataggaagatacagtgtggattaaaagatggtgaggacctagagataagaagaaatcattgcagcaatgatgagaacctgatctcaggagatgaaagtagaaatagaaaagagggggtagatactaggtaaagttccaaaggagaaacaggtagagagcttaatagaaaatgaagtataagagaggggtatcagcaataattgtcatgttatggaacatggagcaatggagaagttaggaagtataaagagtatgcatcgttgtagatgttgggggaggatgctgagcagcttagaacctgctgaatttaaggtaactgctggacaaccaagtagaaaaccccagggaagcagctgtagaggtaacaatatatgagttagagttaagaggaaacagaagaagttgaatcatcagagcagtgacatttgatgctgtgagaatgtgtggtcttaggcagaaatagaatacagagaggagtagaaggctaatgcctagaaccatctgcatgtagggataagacagaaggagatagcctaggccaggcacagcctcacgcctataattccagcactttaggaggctgagctgggtggatcgcttgagctcaggagtttgagaacagctgggacgacatggtgagaccccgtctctactaaaaatacaaaaattagccgggcgtgttgacgcacacttgtagccctggctactgggaaggctgaggcagggagaatcgcttgaacccgggaggcagaggttgcagtgagctgagatcgtgccactgcactccagcctgggaaacagagtgagactccatctcaaaggaaaagaaaagatggaattagtctggaagccaatttaaaggagagaccagagagtgaaaagaagaaagaaatagtatactgtctgagaagcaattagaaggaatttttttcttcagtgctacagagaggtctcagaagggtgatttctaggaaagtttttgttaggagacagaaacagtgagattgtggtttggagaattttagaggctatctagtttattttgtttgttttagtttcaaatctttattcttttttactttttaaattattcttaattgacataattgtacacatttaggggtacagtttttattttgatacatgtatacaatatataatgatcaaattggggtaattaggatatccatcacctcaaacatttatcaattctttgtgttgggaacattcaaaactcacttttctaactatttataaacatacagtccaggtgcagtggttcacacctgtaatcccagcactttgggaggctgaggcaggaggaacacacgagcccaggggtttgagacaagcctgggcaatatagggaaaccctgtctctacagaaaatttagaagttagctgagcgtggtggtacatgcctgtagtccctgctattcaggaggttgaggtgggaggatcacttgagccttggaggtgaaggttgcagtgagccaaggtcatgccactgcactacagtctcagtgacagagtgagaccctatcttaaaaatacatacactgggcgcggtggctcacgcctgtaatcccagcacgttgggaggccgaggcaggcggatcacctgaggtcaggagttcgagaccagcctggccatcgtggtaaatccccttctctacgaaaaatacaaaaaaaaaaaaaaaaaattagccaggtgaggtggtgggagcctgtaatcccagctacttgggaggctgaggcaggagaatcacttgaacctgggaggcagaggttgcagtgagtcgagattatgccactacattccagcctgggcgacaagaacaaaactccaactcaaaaataaataaataaataaataaataaaatatatatatatatatatatatacacacgcacacacacacacggtaaattgttgttgattatagtcattgtatagtgctatagaacactagaacttattcttcctgccgatctgtacttgtgcatctattaaccaacctttggctctcccctcattcctgccacccttctgtagtaaccactgttgcactttgtacttctatgagatcggctttcttagctttcacgagtgacagcatgtagtatttatctttttgtgcttggcttatgtcacttaaaacgtcctccatgttcatctatgttgtcataaatgacagaattttgcttttttaaaaaatgtctgaagtattccagtttgtttatacaccacattttctttatccgtttacctgattatggacacataagttgattccctatcttggcccttgtgaatggtgctgcagtagacatgggagtgcagatgtctgttcgacatactgatttccttttctttagatgaatgccccatagtgggattgctggatcatatggttgttgggcggctgagatgggtggatctcttaaggccaggagtttgagatcagcctggtcaacatagtgaaaccctgtctctactgaaaatactaaaaaaaaaaaaaaaaaaaaaaaaaaattagctgagagtggtggtacacgcctgtaatcccagctgcttgggaggctgaggcacaacaattgcttgaaactgggaggcagaggttgcactctagcctgggtgacagagcaatactctgtctcaagaagttaagaagaagaatttacatccctgccaacagtatataagagttcctctttttccacatccttgccagcatttgttattttttaatctgtaacagttattctaactgaggtgagatgatagttcattgtggttttgatttgcatctccctgatgattagttatgtttaacattgttattttgagagatatctatttagctcatatcccattttttaatgcattgtttttcttcttttttgctgttgagttcttgtatattctggatattctttgttggatgaattgtttgcatatactttctcccattctgcagattgtctctacactgtgttgattgtttcctttgctatgccaaagctttttagtttcatataacccaatttgtctatttttatttttgttgcctgtgctttttatgtcctctttataaaatcttggctcagggccaggtgtggtggctcgtgcctgtaggcccagcactttgggaggccgagacgggtggatcacctgaggtcgggagttcaagaccagcctgaccatggagaaaccctgtctctactaaaaatacaaaaattagctgggcgtggtggcgcgtgcctgtcatcccaactactcaggaggctgaggcaggagaatcacttgaacccaggaggcggaggttgaggtgagccgagatcgtgccattgcactccagcctgggcaagaagagcaacactccatctcaaaaaaaaaaaaaaaaaagaaaagagaaaagaaaaatctttgctcagacctgtgccctgaagcatttttcctgtttaatccattttgagttgatttttgtacgttatgagagaaaggggtctactttcatttttagcatatagatttctgttattccagtaccatttattgaagagagtgtcctttcccccaatgattgttctttttttttgagacagagtctcactccgttgcccaggctggagtacagtggcgagatctcggctccccacaacctccgcctcccaggatcaagcaattctcttgccttagcctcctgagtagctgggattgcaggcacgcaccaccacacctggctagtttttttatttttaatagagatagggtttctctatgttggtcaggctggtcttgaactcctaaccttgtgatctgcctgcctcagcctcccaaagtgctgggattacaggcatgagccactgtgcccagccaatgattgttcttagtgtctttattgaaaatcagttggatgtaaatatgtgggtttgtttctgggttctctcttctgttccactggtctatgtgtctgctattatgccagtaccatgctgtattggttactatagctttgttgtatatcttgaagtccagtagtgtgatgcctccagctttttgttcagaatggctttggctattcaggatcctttgtagttcagtatgagttttaggattgttttttctatttctgtgaagaatgtcattggttgtttttgtttttgtttttgttttttgagatggaatgtatcactctgtcacccaggctggagtgcagtggcacattctcagttcactgcaacctctgcctcccgggttcaagtgattcttgtgcctcagcctcccaagtagctgggattacaggcatatgccaccacacccagccactttctgtatttttagtagagatggcatttcgccatgtgactggtctggtcttgcactcctgaactccggtgatccgcccaccttggcctcccaaagtgatgggattacaggcatgagccactacacccagccgtcattggtatttctgtagggattgcattgaatctgtagaaatttttaatagtacggttattagtggagtattaatttttcaacccatgaacatgggatgtctttacattttttgtgtgttttcttcagtttcttttgtcagtgttttatagtttttgctgtagagatcgttcacctccttggttaaatttatttctaggtttttgttgtttgtagctattgtaagtaggattgctttcttgatttctttttcttctagtttgttgttttatagaaacgctgctgatttttgtatgttgattttgtatcctacaactttacttaatgtgtttatcagttccaataattttttattggtggagtttttaaggttttctgtatataaggtcatgttgtctgcgaacaggtatagttcaacttcttcctaattctgatgccctttatttctttctcttatctaattgctttggctgggacttccagcagtttgttgaataaatgtggtgaaagtgggcacccttgtcttgttccatatcttggaggaaaagcttttagttttctctgttcagtatgatgttggctgtggatttgtaatatatagcctttattatgttcaggtacattccttctgtgcctaacttgttgagagtttttcttatgaagtgatgttggattttattaaatattttttctgcatctattgagaagatcatatggtttagcccatcattctgttgatatactttgttatgttcattgatttgtatatgttgaaccatccttgcaacctttggatctttttaatgtgttgctgaatttgatttgcttgtatttcattgaggatttttgcatctgtgttcatcaaggatattggcctatagttttcttttcttttcttttcctcctttttttttgtttttgtttcttgtatccttgtctagttttggtatcagggtaacgctggccttgtagaatgagtttcaaaaaattctctcttctattttctggaagagcttgaaaagaattggtattagttcttctttaaatgtttgttagaattccattggttcctagacttttgttttctttgatgggagactttttttttttttcttgagacagagtcttgctctttcacccaggctggaacgcagtggcacgatctcggctcactgcaacctccgcctcacaggttcacaccattctcctgcctcagcctcccgagtaactgggactacaggcgcctgccaccatgctcggctaattttttgtctttttagtagagacggggtttcaccgcgttagccaggatggtctcgatgtcctgaccttgtgatccgcccgccttggactcccaaagtgctgggattacaggcgtgagccactgtgcccagcttttttttttttttttttttttttttttttttttgagacagtcttgctctgacacccaggctggagtgcaaatgggagactttttattacagattcagtcatgttacttataattgatcttttcagcttttctgctttttcttggttcagtcttggtaggttgtatgtgtccaggaatgtatcaatttccataggttttctaagttggtgtgtagttcataataatttctaaaggtcctttgtatttctgtggtgtcagttgtaatgtctcccttttcgtttctgatttcatttatttgggtcttttcttggttagtttagctaatggtttgtcaattttgtttatcctttcagaaaaaaaaaacaacttttcatttcatctatcttttgtcttcatttttagcctcatttttgtttatttctgttttgatctttattatttctttccttctagtaattttgggtttgctttgttcttttctggtttctcaaagtgtatcattaggtcatttgtttaaaatctttccacttttttgatgtaggcatttattgctataacattaccttttaatattggttttgctatattttataattttcaatatattgtgtttccatttgcatttgtttcatggaatttttaaatttccttttacatttccccattggtcattctggagcacgtttaattaccatgtatttatacaattttgaaagttcctctttttattgatttctagtcttactccattgtgttcagaaaatatatttgacattatgacttcagttcttttaaatttgttgagacttgttttgggtcttaatatgtggtttccccaggagaatgttccatgtgctgatgacaagaatgtgtattctgaagctgttggatgaaatgttctatgaatgactgttaggttcatttggtctgaagtacagtttaaatccaatgtttctttgttgattttctgtctagatgatctatccagtgctaagagtggatattgaagtccccaactagtattggagtctgtctttcccttttaatataataatatttcctttttatatctgggttctttggtgttgggtgcatatataactctcatatcctcttgttgaattggtccctttatcattatagaatgccctttgtctctttttatagtttttgatttaaagtctgtttgcctgatatatgtatagctactcctgctcactttggatttccatttccatgaaatatctttttcatcccttccttttcagtctgtatgtgtctttacgggtaaagcaagtttcttggaggcagcatatgatagttgggtcatttttctttttaaatctattcagccagtctatatctttttagtagggaatttatccacttatattcaaggttattactgatagatcaggacttactcctgtcatttttaaaattactttctggttgctttatatatccgtcgttcctttctttctctcattgtttatcattatggtttttgtggttttctatagtgctaaggtttggttcttttttcccttagtgtatctgctctaccagagtgttatattaatactttttgtgtattttcatgagagtgattatcatcttttcacttccagatgtgggagtccgttgagcatttttcataaggtgatgaattccttctatttccccatgtctgggaaatactgtatttctcctgtatgtctgaaggatggttttgctgggtatagtaatcttggctgccaatttttttcttgcagtactttgaatattatctcattctctcctggtctgtaaggtttctgcagaggcagccatctagtttaaacttccacccagcacaggaagagaaagttttagaggtggtgtatgtaattctttaatgggatgcttcttgaccttggggatggatccaacatcccacttttattaatatatattcataatatcccctttaatacactgatttatggatgaaataacctattgacaatccctagaaaatacttatacatagccttaactgtaatataagggattaaattttttaggtaatttataatgaaataatatgtgttttaatacatgtctatttggggacaactatgttagaagatatacctaagaagtcaaatatttgttcctacttataagaaaaggtttaagacaagatcaaaagccattctctataagaagtactggaagggctgagtgcggtggctcacgcctgtaatcccagcactttgggaggctgaggcgggcggatcacctgaggttgggagttcgagaccagcctgaccaacatggagaaaccgtatctctactgaaaatacaaaattagccaggcgtggtggcacatgcctgtaatcccagctactcaggaggctgaggcaggagaatcgcttgaacctgggaggcagaggttgcagtgagccaagatcgtaccattgcactccagcctgggcaacaagagcgaaactccatctctcaaaaaaaaaaaaaaaaagacaagtagtactggaaaataaaagaacagatgagaaagataaataatagacttaagtatatgtgataacaaaaggagggaagtaacctaaataaagtatgaataatacacctgcaaaaataaattatagatggtcaaggtggagaaaaatgaggtagatcttaaaagcatagtatcagaatatatctcctgtcatgaaattctactataggccaaggctctaacatgtaaaaaagcctcggagaccataacatttgaaaggtggctgaaaataggaacataggtacaaaagtctacacagaagttgtatggtttagggacagtgtcagagtttttaatatttgattttaaatctattaaaagcaattcagaatcctttctgttacatactaatgtgcattattaaatgaaactcctttccatctatgtagttaaatatgctgctaggtatggtgggcacacatctgtagtcccagttatttggaggctgaggcaggagaattgctggagcccaagatttcaagcctgtagtgcactataactgcttctgtgaacagccactgcacttaagcatgggcaacatagtgataccctgtgtcttaaaaaaaaaaaaaatttataaaaaatgaaatgtgaccaggtacagtgactcacacctgtaatcccagcactttgggaggccgagacggttgggtcacttgaggtcaggagttcaagaccagcctggccaacatagtgaaaccccatctctactaaaaatacaaaattagccgggtgtggtagtgggcacctgtaatcccagctactcgggaggctgaggcaggagaatcacttgaacctgggaggcggaggttgtggtgagccaagattgctccactgcactccagcctgggagactccgcctcaaaaaaaaaaagaaaatgctataaaatattgagtagagggtggacatgatggctcatgcctgtaatcccaacactttgggaggccaaggtgggttgatcacttgaggccaggagttcaagaccagcctggccaacatggtaaaaccccatctttactaaaaatacaaaaattagttgggtgtggtggtgcacatctgtaatcacagctactctaaggcatgagaattgcttgaacccaggaggcggaggttgcattgagccaagattgtgccactgccatccagccagggtgacagagtgagactctgtctcaaaaaatatatatattgagtagagagaacatgcagagtgagttaattttaatttatgtgttgaacaccacagaataattttaactgtgtttttttataacgtttcctatattactggactttttacataactacttgtgaaaacaattcagtgttattaaatacaaaagcactaacaatttatattgggtatacttagtatacagggtttagtcaggtgggacatgagaaagttctttgtgtctgacagtgtcacacattacagaacagttagcgttcctgcccccttctaattaaaatatctagtagcattaccagtcattgagaccaacaataaatgcttcctagggaaaagtaatgatcttttaaaaaactggtgtttttatgatcacttttcacagctatctccagcagcaggtaaatgaggggcaagtattttatgtttatacttgtatctgtttttgtaagggtatgccctacaggacctgtaagttccagcattaataatatggaattcactaggatatttacatttcacaaagttttattaattctgtatttaaatcaagttttattgtagtttcgttattgtctttcaaactactaaaattaagctttttgtgtgttcttgtgtaagcttttattaatcataacaatgtgttattccggctaaagaatgctagatgaaactgcattttctcctttgggacttatattaacaaactatagtcttcaaacttttacacttaccagaatcacccggaagcttgttaaagcacatattgctgagcctgacccctagagtttcttttttgtttgttggttgcttttgggttttttgggtttttttttttttttggtttttttttttttggttttttttttttttgagatagggtctcgttctgtcacccgggcgagagtgtagtggcgcaatcttgagtcactgcaactttgctgcacagattcaagcaattctcctgcctcagtctcctgagtagctgggattacaggcatacgccaccacacttggctagtttttgtatttttagtagagatcaagattcaccatattggccaggctgatcttgaactcctgacctcaagtgagctgcccacctttgcctctcaaagtactgggataacagacatgagccaccacacctaacccagagtttctgaattagtaagatgatgtgtggggcctgaggatttatggttctaacaagttccctcatgatgctgatgcttgttggattggggaacacagtttgagatccactatactaacaaactgtttatgatttcattatgttttagggagcaatggaccacagaaattctgcattgaaaaagttgggaaagaaaattggctacccagaagtcatacctggtaagtacaatcagaatggatagagaaaacagcttttgtccagttatctgtagctatttaaagccagctagaaattaaaaatgatatttagtagatttacagaatagcacagccatcatagcaatccagtttaagagcattttgttcacccctgtatgattccttacaactatttgcaatcaattccttttttcacatctgaattttttttctaatgtgggatttagagttattttaacttttctctgagggcagcaaaagaaagttaggagacctactttctaacatcatgaccacaaatattctcatttgaaatctaattacatttctaaaaatgtagaaaactaaatctaatcctaatctgacagcaaatatattaatattttggaattcaacctaatgtcaacaatatttgaaccttattttgtgggatatattttagtggtcacatatggtccttcctggatatctgacctctttactgttttactaatgtctattcctttttgtttttatacataatgttttgtacatgcatgtagtgtttaagtaacaattttattgatatataatttacagattataaaactcaccttcttaaattatgcagttcggttcagtggggtttttttgtttgtttgtttgtttgtttgtttttgagacagggtctcactttgtagaccaggctggagtgcagtggtttgatctcagctcactgcaacctccgcctcccaggttcaagcaattctcttgcctcagcctcccaagcagctgggattacaggcgcccgtgaccacgcccagctaatttttgtatttttagtacagatggggtttcgccatgttggtcaggccggtctcaaactcctgatctcaggtgatccacccacctcggcctcccaaagtgttgggattacaggtgtgagctgccgcatctggcctgttcagtgattttagcatatttatgaggttatgtaagcatcattactgtctaattccagaattttttcaccctcccaaaaatccatgtacccattagcagtcactccctttttaccccgtgtagcccttggtaaccactaatctactttctgtctctatgaattttcctgttctggacatttcatataaaatgaatcatacgataaatatataacttttttttttttggagacagtctctctctgtcacccaggctggagtgcagtggcgtgatctcagctcattgcaacctctgcctcctgggttcaagtgattctcctgcctcagcctcccgagtagctgggactataggcagcatgcaccaccacgcatggctaatttttgtatttttagtagagacggggtttcaccatgttcgccaggctgttcttgaactcctgacctcgtgatccacccactttggcctcccaaagtcctgggattacaggcgtgagccactgcccccagccaaaatatacaaccttttgtgtgtagcttcttttacttagcatgttttcaaggttcatccatggtctagcatatacagtatttcattcctttttaaaattaattgttgggtttaatatacataacatagaatttaccatttttaagtgtgtacagttcagtggcattaagtgcattcatatcattatgcagtcatcaccatcacctatctccaaaaattgtttcttttgttgagacatgtctcagtctgtcacccaggctggagtgctgtagctcaatctccactcatgcaccctccacctcccgggctcaaactgtcctcctaccttagcctcccaagtagctgggacgacaggcatgtgctaccacacctggccaatttctaaactttttgtagagacagagtcttactttgttgctcaggctggtctcgacctcttgagctcaagcaatactcctgctttgacctcccaaagtgctggaattacaggccatcatgccagacctaaaacatttttcatcttgtaaaattgaaatggtacccattaaagcaggggtccccaactcctggtccccagcctgttaggaactgggctgcacagcaggaggtaagtggagggtgaatgagcattacctgctgagctccaccacttgtcagatcagcagaggcattagattctcataggagcaataactattgtgaactgtgcatgtgagggatctagattgtgcattccttacgagaatctaacctgaggtggaacagtttcatcctgaaaccatccccctctccactcctgtccatggaaaaattgtcttccacaaaaccattgcctggtgccaaaaaggctggagactgctgctttaaacaatgactccccatgactccctttccccaggtcctggcaaacatcattctactactgtttctatgattctttagtacttcgtaagtgtagaatcgtaccttatttgtcctttcctggctggcttatttcacttagaataatatctttaattttcatccatgttgtagcatgtgtcagcatttcctcctttttaatgctgaataatatttgatagtctggatatactacattttgtttatacattcatctgtccatggacacttagattatttccaccttttggctgtttatgctgctataaacataggtatactgtggtagaatatagatatatctgtccatggccctgctttcagttgttttgggtatatacccagaggtggaattccttgatcatgtagtaattctatttttaattttttgggggaatctcgccatactgttttccatagtgactacactgcgttatattcctacctgtagtgcagaggggctccaatttctccacatcctcacatccttttcaactcttgttttcttctgttttttttttttttttttttttttttggttgttgttgttgttgttttggtgttttaaataatagccatcccaacaggtgtgaagtggtatctcattgtggtttttatttgcatggtaaaggatgttgagcatttttttaatgtgcttattggtcatttgtatgtctttggagaaatctctatcctttgttcatttttaaatattgttgagttttaagttttttatatattttggataccagtcctttatcagatatatgatttacaaatattttttcccatttttgggttatttcactttcttgatggtatcctttgaagcacagtagtatatttttgtgcttctatagtagtgtataaagtagtatactacactactcatttgattctttgcatatttccttttctcaaactaacaattcttgcttttagttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtaagtaaattaatgttctcatttagatttatctcccagtgatttctactcagcgtttccagaaatcaggtctgcaaatgactagtcagaaccttgcttaacatgagattttaacacaacaatgaaatttgccttgtcttattccactagtttattcctttaacaacaatattttatgtgtgtcaaaagtctcacttgggagtagtgtttttttcttttagacattctgcagacatgcagggaagtcctttggtaactgcaatatacaagattttcctattaagcctcttggtaagaggcatttgttaaaagtgcaagcttactcctgcttctggggatgtgagcaaaattcgggcttgtgttctccctctcattttagtctgacttgactattgtttttcctttctggcgcatgaatccatacatcattcctggaagtgaggcaagactcttgcatctctacaaagtagttttgtcaatttgaattcagggaaaagttggtcacagcctgcaaatgacttcatttggaagtctgattgtttcagttgcctgacaaatactacactttacaaacaatgttaacactgtgattccttcattgttttaagaagttaacctagggccgggcatggtggctcatacctgtaatcctagcactctgggaggccgaggcaggaggatccctttagcccaggagttaaagaccagcctgggcaacatagggagaccctgtcttttttttgggcagcgtggtgggggataaataaataaaaggaaaaaaaacttagcctagaattagaattaatttaattgaattcatctaaagatgtctctggtgatttttatatgttccgctatataattgatgctttatagttttatcataatccaacaacttcagttatatttaattattgttaaggagtttaagactagaaagactagagtgctttctagtccaaatagaggtcagtgaaacagcttttgacatcagattttcatttgagagggagagctgtggtactggctaaaaagaaaggaagataacatccagtaaccacaggaatatattctctgtgaattaaaagtcttcaaagttatcatttctctgacatatgttggagtagtcatttccattctttacattgtcatgaactggattgataaccctcatctgcaatattttcacccctaaaatttttaacagggtttcctttttttctcacgactatttaagtttagattgctccattattaactgattaatgcactttgaagttctctggaattaattattttaacttggcctagcttcgactgtcaaggtggctgttataaatttgacttcattggcagtggatgaagcctaagccagctgagtctctatcatagctgaaccctgaggacagcctcatagctcatgtatcagggacttttgccacatttcagaggcatagcatgaacaagtaatattaagccaagaataagcagcagaaccctgttccatatggaaaaaagaaaaacaattttttgtccctaatgttcttccttttacatcctggaacaacaataaaaacatttttttaaacttgtctactgtaagatactgccatcataaagcagagacttacatgagtgaaagggttgcctcatcaagcagctcagtgtaaatggggaggctaggctctccccagccctatggtttttttatttcatgtaccccaggaaatactgtgtggtttctaaaagccctggttgttaaaagtagggactctgcctttttgttggtagggagaaaaaacgctattgctttgtcttacagagcgaatgtctgccaactacccgttcattatataagtctgaacttggtaatatatggctaatgaagattaagccctctataaagacttcctgttgaggtgaattctcatactgaaatgtagttacctacaatatttactagagatttatgaaattaaattaagagataatgtaagaaaatacatttttttggttctatataatgcttcatgattcatttagggacctagaaatattgtgtgaaaatatataaatatcacccaaaaggctttctgccctatatttttaaaatacagaatagttatatttgaagtagccctggccctagttctatagggcttggctatttaatatttttatggaagaagtgtttagttctggaaaaggtaaatgcttgtatatatttttgcagcctgggatctccctactccattttttcctttaatttaagtggccacatgtatatgtcttccctgctgtgttaggaaaatgggggctggatatcccaagaatcagaggttatataaaaatactgcaaatagaccgcagacataaatatctaccaaatgctatcttaaattttggtccaaactgaacatatggaaatagatttattgtaagtatttacttagagctttttcttaaatctgaactaacttgcttttagaagtctttttctttgtaagcattgtaaatgctaataaatcctgttaatttttttttttttttttttttttttttactgcatgttacattgaaataaaaacaaagtaaaatgagcaattgccttattgttctgctcttttgcagggggtgggggttggggaagacagcattccacagcctggtcaggagggaaggacctcacttgtttcatcaaatggagtggtttaaaactgatcaagcagctcataataatgaattcctgctctgtcttttattatcttatgtcagagtgcagcaaaatctcatttcataagacttacaataactctatttaaaattcaggtattgtactcgggaggctgaggtgggaggatcccaggagttcaaatcctgcctgggcaacatagcaagaccctgtctcttaaaaaaacaaaaagacatattcaggtactgatttttcatcaagagattgacataccaatgatcagaaattttagtgaaacttgactcaactatacacaaagttctcatcctaaatgaactatttcagtcaagcccactctaccactttttacttatctggttaataatccgaaatgttaccggggttgactcacggaattaaatttttcctctatttttatatcctttcctgttgtggatgtaacttacctttctaaactcctttagagttaacgacttctatttagtattgttggtatctccagcccccctcctttttttgtttttcttttagttatttactttgtttgtataatttgctttcattaactaaaaatggaattggcagcactggattgtatattactgtattaagagtacctttgttttcttgatctgttacttttaatactcaggtaatgctacaaatattacagggagtcaaatgcttttataaagttccttcagtggttgcctcacttgcgttttcctacaagatgtaagactgtttataattaaacttttttggtccttcatttgcatgcttttctatcagtcttgggtaaggaggggtctctttcctctctccccggccccaccttctgagacttatatgtgaccaggtcacatagatttctgcctctctgcttttttaagtggcaagttacagcccatctggattgtggtattgttcccagaccaaatcaagggttggactgcttattctcgcagcccaataatgaggtgcagatgaactgagaaaggagggagtttatttctgtaaccaggtatggggagaaagcctggaaatgatcccaagaccaactcaaaactacaaagttttccagagcttatttacattataagctatatgtctacatgtgagtgtacattcatctaaagacataagtgattcacttttttaaatctataaataagatctgagccctgaagaccttcctctggagcctcagtaaatttacttaatctaaatgggtccaggtgctggggtgattacccttatcttgtttcctgctaaatcatggaggtttggggacttccttcagacccccagtaaacttgtttgtggaggccttcagaccccctcaataagttccttcagacccccaataaaacttgtttaatcctaaatgggttcctttgttatcttgtcatgcttcaaggcccagaaaaggcctgggcaaaacccttggtggccttttgttacattctagcctttgcataagggccctcactctttcagcttttaatatttaacttaaccactcagtgctgaaacagttgttatggaggcctgcgttattgagatctggcctgccacggtacgggtagaaaaaaactagaaagagctgttgcagatgagactggatttggtgcccatgttgaagatgaagatatctgcaggggccatcaaccaacataaaggcctccatatgaattgcttttctgagacaactaaaagaccgggaccacaggcatgagtgctgagtagagaaccaccaactagctagctgtcaagactgttaccaagactgttctcaacaagctgacctggttaccagcgtcagtagaactttgtcttattaggaagctcaggtgattatgctctcatttaaaacagaaccagtggagagagactaagggaagaggaattttttaatacggctgatctaacatggactagaggacaaaaactgcaggcccctcccaggtcctgagtagttagtagaccctatcctgtttattctgtccaatggaagctgctagaatgctctagtttcattgtggcttagaataaggggaaaaatatgccccgctaagtgagggtcaatggtcagtaagtaattgttcttactggccattggctctcatcccaaaccctacaaatcatcaaactgggactcagctgtgactgactggctgttctctggactttttaagtgtctgtctcacattatgtaactccagtacaggagctgctctctctcccagcccatttcagttgtcaattcttccatgttcataggactcctttgtgatcaggatatctggagtgaggagccaggggaatattcctggttggcaaggaaaagagggccttaaacataaatcccagaaggacactgttgatcacttatgcacaggggtctgttaataagcaaagagtggctatggacaagaggatttcctcaaagcaccccacagggaaggaccttgacaatttgtagtcatacttgaaagatcactaaaaacagccctcctgttatttttcttctaattcagacctgttgttctatttgtcttccatatcatagcaaccagtaccacacccatattcatttaataccaaaacaactgtcaacatttatcactatgtgcaggacactggtagatatgctatgtgcagtgtcacttagtcttcctgttattggtaatgattatctctgttttacaagaaaatagaggctcaaaatgattgaatcatgtccacaactattaagtagaaagaatacaggctggaatccaggatggtttgactctaaagcatgcatactttaccatttttgttgtactgctacttaccacaacactgggagtcgaatgtgaccaattttgccattccatttaattagtctccaaatcctatctatccccaaaactttttttttttgagatggagtcacgctctgtcgcccaggctggagtgcagtggcgcaatctcggctcgctgcaacctccacctcccgggttcaagtaattctgcctcagcctccctagtagctgggattacaggtgcccatcaccaatgcacggctaatttttgtatttttagtagagacggggtttccccacgttggccaggctggtctcgaactcctgacctcaggtgatccgcccgccttggcctcccaagtgtttggattacaggcatgagccaccgcgcctggccccaaaacttttaaaaatccgttctctcagagctgacaacattgccacagcccacgtgcttcctccctaatctggctgaccataacagcatcctgtcttcatttttccatcctcctcgctccagtatatcttctgtactacctcaggattatctgtggaagacctgtctcatgcctcctctacctaaaattttacagtggtttctccattaccgcagaataaaacttttttttcttttttttgagacggagtcttgttctgtcgcccaggctggagtgcagtggggcgatcttggctcactgcaaccgccgcctcctgggttcacgcgattctcctgcctcagcctcccgaatagctggggttacaggcgcacaccaccacccccggctaattttttgtgtatttttagtagaggggctttcactatgttggccagactggtctcgaactcctgacctcgtgatccgcccaccttggcctcccaaagtgctgagattacaggtgtgagccactgcgccgggccaaaactctaagcctgccactccgggacattcttggtcctattccagctcctccttcattctcattttggctcctgtcacatgaactattggccattctcttttttgcttctgggattgtaatctgttaaaatcctttcactcctctcagtctggttctccatgggcaagacagtggtgattcttccagtgcttatcttccaggatgttttagggtccagtctctgcagcacttcttccccttgctaaatgctttcctaatgtttccagcattcaatagaaattcctttggatccagtccttttaaaaatttattttgaaataattttacatttacagagctgttgcaaaaatggttaagagttcctgcacagtcttcacccagctttctccaatgttatgatcccatataaccatgctagaattaccaaaactaataaattaacactggtaaaaataacactaaactacagcccttactcagatttcaccaattttcccacccatgttatttttctttctccttactcctctaatctgtgacagttccgcattcattccttgctttcatgactttgagattttggggggcgggggcggggtacaggtatcttgtagaacatccctcacactggatttagtgaaattttctcatggtttaaggctgggagtttttgtggaaaatgactcggaggtgatgtgcccttaacgcatttttatcggggcacacggcatcaatatctccccttgccagtaatactaactttgatctggttacggtggtgtctgctaggtttcttcgcagtaaagtcaatcctcttaacatgcagacactcctggaaggagaaccaaatccttcctcactgaagagcagctactgtggaatgaaactttggagttagatcatcgttgaatccagcaagctacagtgcctgggagaaacagcatttataaagtatcgaggttaccgatacttccctgaagctaccggagataacgttatgtgcgtgttcagcacagtaatgtggcacagggttcactaaacggcagcatgttttaacagaagttatttactcctagaggacccagaaacgtttgcggcctgccggaacaggacaacatagggctctgggaagagtccccctttcagaggtgagaacaagacagaacacacagatgtgaagtgccttctgctaggtaacgcgaggcggggctgagctcggattctaaagactcccaggccagccctaaccaattcatctccgagcttgcacggcatcttacccggagactcgaggtacctgactccagccccaccccaggcctgcccgatcccgaagcgcattttggccctgggcctctctctggctcagtctgggcgcaaagcgggtctcagcaaccgtcccacttgccttcataccctcccaccacgctccactcagggactccagaaccagcttagacctccattgagagctgaaagcctcttccgataccgagaaccagcactgaaagcctcttccgataccgagaaccagcatggtttttgttttgttttgttttagtcagggtctcttgctctgtcgcccaggctggggtgcagtggcgcaatctcggctcactgcagcctcgaactcctggtcaggcgatcctcctacctcagcctctggagtaactggaactacacgagcgcgccaccacgcccggctaattttgtttattttttagtagagaaggggtctctccatgttgcccaggctggtctcgaactcttgggctcaagcaatccttccgactcggcctcccaaagtgctggaattacaggcgtaagccaccgcgtccagccagaaccagcatcttttctgcacggctggagttgggaattttccacagcttagcgcactgctccttagcttttcgctttgccacagtggaaagcagattttccaagaatcctggcggagccaagatcggctcgcccgcccccgcctcacgctggctcctgataggcagctagagctgtccgttttgacagaaacctttgcgcaggcgcagaaaggcacaggactcgctaagtgttcgctacgcggggctaccggatcggtcggaaatggtgagcgtgcgccggggtcttgtggctggcggccgcccaccaccccacgccaggccttcagtcttccgaggatgaggggatctcagagctccggacagggaatcggtggtggctgggcgtggccgggcccgggccccagccgacttgagggtggaacccggcggcggaggcctctaaagcctgaccgaggcggggccgccggatcccgctgccccttgaccggaagcgggagcccagcctcggccaggaagagatgatgggcgaggggtgggcggcggccctgcagcctagagttttggggccttggtgcgcgatggcaaccctggcaacgtttcccgggagctcagtttgtggcaggctctgccaagcactttatgtatcttgtatttcctccgcctcctcccagctctgtgaggtagatacaatctttagtcccattttgttatacatatctgttattcagcgccccgagaagccaagtgctttgccccaggaaatagtggagatggatttgaaccctagaagcttgacggccgccactctgtcggcgtggttctttctagccgctgggactgggtgccagagtcaggaacgggcggggtctgctcttggggatcccaaagcttgctttctaccttgcttgctgcagctgtgggttctcaacgccgttacaggttttgtgtttgtaatcctcacagcttgggcaaaatttgaaaaagtttcaaattttaagccatgtgaatatattactttttcaaaaatcttatttagaaatctagagcttgtaataaaaaaattgaaaaaagaaaccgtgtcatcacctagaggcaaccacttacagtagtcatatgacttctagtcttttttgcttgtttttggtttatacagtttagcccctattgaatgtgcaattgtgggttctgtgtttttcattattacaccacaatatctccacatcattacaaacatgtaataatgcttcaaatatgtataacttcatttttcacatcacttcttaagctgtaaaaaaaattgatatataatagttgtacacatttatgttgtagatatacatgtaatattttgatacatgcatatgatgtgtaatgatcaaatcaggctatatttattatagaatatccatcaccttaaacattcattatttctttttttttttttttttttgagatggagtgtgtctctgtcgctcaggctggagtgcagtggcaccatcttagttcactgccacctccgcctcccaggttcaagtgattctcccgcctcagcctcccgagtagctgggactacaggcgcccaccaccacgcccagctaattttttgtatttttagtagagacggggtttcaccgtgttagtccgcctcaacacggtggtctcgatctcctgacctcgtgatctgctcgcctcagcctcccaaagtgctgggattacaggcgtgagccaccacgcctggcccacattttctttatccatttacctattgatggacgctaattccataatttagctattatgaatagtgctgcaatatgaacatgaggatgtagggatgcctttgatgtactaatttccgttcctttgaataaatacccagtagtggtattgctgatttatggtaggttttttttttcgtttttgttgttgtttttgttttgttttgttttttcgatgcctttgtcgaaaatcagttggccgtaaataagtggatttatttctgggtcctctattctattccattggtctgtgttttataccaataccatgctcttttggttactatacctttctggtatattttgaaatcaggtagtgtgatacctcaagctttgttcttttcgtccaggcttcttttggcttttctgagtcttttgtggttccatacgaattttaggattgtttacaggtaatacttgcacacagtaaaaaaataaatgatgtaaaaggatctaagtgaaaaataaaattcccactctcctaacccccagtctcagtctctcctcctttagaaacaaccattgttagtttctttttttttttttcttgcaaacttgaccctcctgggctcaagtgatcctcctgccttaattccccaagtatctgggactactggtgcacgccaccacaccctgctaatttttttgtattttttttttgtagagttggggttttgccatgttgcccaggctggtcttgaactcctgggctcaagtgattcacccacgttggcctcccaaagtgttaggattacaggcgtgagccaccacacccagctgttagtttcttatgcatctatacaagcacttatatggcccccctttttcttacttaaactgtagctttctagaacctgtattatgctactccgtggttatactcataaaagcaatgcaaatttagatgcctagtttaactttttttttttttcttttgaaacagagtcttgccctttcgcccaggctggagtgcagtggtgtgatctgagctcactgcaacctctgcctcccgggttcgagtgattctcctgcctcagcctccggagtagctgggactgcaggagcatgccaccatgcctggctaatttttctatttttggtagagacagggttttttttctatttttagtagagacagggtttcaccatgttgaccaggctggtctcaaactcatgacctcaggtgatccgcccacctccgcctccaaaaatgctgggattatgggcgtaaaccaccatgtatgttaacaatttgaagcagtaccagaggatataatatagaaagtttatgtggtccccatcttactaccccgtggcaacttctgttggcagttgggtgtgtttccttccagatgtgtttggtgcataagcacatttatgtataagctgtttattagatgaaactggaatatatatatatttgtatatgttaactttactttaaggctgaagtggagagatcgcctgagcccaggaggtcaaggctacagtgagccgtgactgcaccactgcactccaccctgggtgagaaaaaaataagagaaaacagaagttgactttaagatatatatgtatatatcttattctgcaacttgttctgttcacttaaaaatatcacacatttttctgtgttattatatgcaggtccacttcattctttttaaggtctgtatcgtatcctagtcccatatgtacatttaggtggtgtatagtttttttattccagacactgctgcagtaactgttcttgtcttttttgcactcatgctagtggttatgtaggatagatttctacaagtggcacttttggcttgcatattttacattttaggtggaaactgacctttagaataatgatataaaaatcatctataattggccggacacaatggctgacgcatataatcccagcactttgggaggccaaggtgggcagatcacttgaggtcaggagttggagaccagcctgggcaacatggtgaaactctgtctctactaaaaatacgaaaagtagccggaagccgtgcatctgtaattccagctgctcaggaggctgaggcactagaatcgcttgaacccgggaggcgggggttgcagtgatccgagaccaggccagtgcactccagcctgggcaacagagcaagactctgtctcaaaataaataaataaaattaaaaaataatcacatataattctcctcgtccagtttcactgtgccacataactattttcatctttgtatgttctccttcctcttttgttcacatatgcatattttccaagataatgcatgctgagttttggggggatttttttctttttttgttgttttaatatccaaaaacatttaaccttgttgtcatatcatctttgtgattaactacttagtgactacataatactcggtgaaatagttgtaccataattggccaaatatcttacctgtgtacatttgggttgctcccatttctttttggtttgtttgttttagagatggagtctcactctgttgcccagactggagttcagtggctcaatctcagctcactgcaacctctgcctcccaggttcaagtgattttcctgcctcagcctcctgagtagctgggattaacaggtgtgcatcatgacgcccagctaatttttgtattttttagtagaaacagggtttcgccatgttggccaggctggtctcaaactcctgacctcaggtgatccgcctgcctcagcctcccaaagtgccaggattacaggcatgagccaccatacctggctgcttccatttcttaattagtagaaatagtgctgtgatgatgcttctgtgaatatcttgttttgtttcattttaacttacttattagattatttcctcaggataaaattcttaggaaaataatttctgaggtggaaggaccagtgcttttatggttcttgcaatatattgtcctgtagctttgtcaagattgtattgcccttgcacctgccagttttgtaataacaatgccagcatttaaaaataaacctcagcattgctataatttttcatttctgtcttttttttttgaaatggaatctcactctgttgcccaggctggagggcacgatctcagctcactacaaactctgcctcccaggttcaagcaattttcctgcctcagcctcctgagtagctgggattacaggcccatgccaccatgacggctaatttttgtatttttagtagagacagggtttccccatgttggccaggctggtctcaaactcctgacctcaagtgattcacccacctcagtttcccaaagtgctgagattacaggtgtgagcaccacgcccagctgaatttttcatttgtttgtgagggatgatgaccatggtttgatgtgattgtaatttctcgtaggcatattttctactagtattcttttgtgcactacctactagagacttgctattgttcttagtcattttgtgttttttttttatttattttgtctgttatatttgatgcaaatacttttctatcctgttagattagttattcttatacagaagttttatgtttagtggtcaaattggtcatagttctttgtcagtcatttgcttccagtggtcatccctcctatgctgagccaatggatcctcctggatctttattgctgcttgtttttccatgtgtcaggaatgtgcatctgggaactagagaattggggaaccttgtctccatcatcccattgcccagagtgcatttctttctcatcatttgattcttggcttaaagatgacatacttatggccgagaatggtggctcacgcctgtagtcccaacagtttgggaggccaaggcagtagatcacttgagcccaggagttcaagaccagcctgggcaacatgtcgaaaccccatctctacaaaaaattagctgggtttggcagtacacatcagtagtcccacgtgttcgggaggctgaagtgggaggatcacttgagcctgggaggtcaaggctgcagtgagccatgatcgaaccatggcacgcctgggtgacagagtgagaccctatctcaaaaaaaaaaaagattacatctcctcaggtgttcctgaccacattagccagagtagcatcccttgccccacagcctagtccctgtatcctgcaagaatcttgctcacttgtttaagtctctttcaccagaatgtgagctccctgagggcagggacctcctcagttgtggtcaccagtatattcagctcttctgttgacctgcagtgtgttcttgggcaaaacccttctcctttccaaacctgtttccccatcactaacatggagatcatactaacccatgaatgggagtttcagaagagagcatgtgtctgaaagcaatatatgacccatagtaggcgctgagtagggaaattatacctatgtgtcctcccattcctgatagatgtgtgagatgtgtgtttacttttcttttttctttctttcttttttctttttcttttttttttttttttttttttgatgagtcttacactctgttttccaggctggagtgcaatggcgcgatcatggctcactgcagcctcggcctcctgggctcaggcaatcctttcacctcagcctcccaactagctgggactgcaggcacacgacaccacgcatggttaattttttttatcttttgtagagacgaagcttcaccatgttgcccaggctggtctcaaactcctgggctcaagcagtctacctgctttggtcccccaaagtgctgggattacaggcatgagccactgtgcccagcccatgtttacttttaaacagccagatcttagtatctggttctcgttgagtttcagatcacctaaaccttagctctttttcacactgtggactgtgaggccatgtccccctcctgtacttaaaaaggttgatttcgtgaaacatagttgcagaaatgctttttatttgttccttcagtatttattgagcctatcctatgcgaggtactggggctataaagtctggtctggtttcctgattccagggtgccttgcgtctggaggaggagatgaacgtgacctaaacagttgcactgcattgtggtcagtgctgcgaaggctgggggcctcggtgcccagtagaggggctgatgtcagagaagcctcctgcgggctctggagctgagtccaaagggttgggaggtagttacatcaagcagtgagtgaaggagggaagcttgtttccttcagaccgagagcagcacctggcagggcaggggtaggaggcttccgcaggctgtgttcgccccctgctgtcccttctccccacagcagccagagccgtcctttggaagcatcaggtcttgtcactctttacctcaaaacttgacagtggctccatgaatcacgcccagtgaaaaccaaggtcaacacttgatctgccaggccgtctgtggtctggtcccggatcccagctgctgtccctcccctgctccctgcccttcagccacagtggcccctttgcttttccccctgaacataccggatgcttgcccaccccagggcttttgtgcttgctcttggtgctgtctggaacactccccagaaaccggcatggctaactccctcatttccttcagatgtctactcactattgccttggtgagccttctctgatgatgtatttcacattcccatcacccctgcattccaggtcccgtttccctgctgtagctgacatttatgttttacttctttttgcttatttaatgtcctttcccacaaatgtcagtttcgtgacatgggatttttgttatattttgttcactgcatcatcacaggcctagaacaatgtctggcatatggaaggttgccatgtagttactaaatgaatagcagtcttaagaaatttcatctttttcatttcagccccattctccaatctctgggggctgttttggatttagattctgacatctcggttttcactttctttcccctttctttctgggttgattgcagattgagctgtcttaaattgtcatccaagttattcttacatcttattctgacaacattgagtgtatcagagccttgtggcccctgtatcatagacttcttttggatgcatagatggggggttaaaatgtttttaaatagaaacaatacagtagaatgaaaaagggtgttttgaaaaaaagaaaataaaacctttctataattccttgcccttaatgtggctcttttttcataatctcctgtaaccttttgttttcatgtgattgcagtcaccaaagcactttatttttgcattttgctgttttcacttaacattatagcacacaccttttgtgatggtataacatggtctaatcaccatggttaatatgtgtattcctattagtggatgttccataatctacttggccttttccctaattgttaggcatttttagttctttctgcattctgctattgcaaatgtcactgtactttggtccatgatgaatttccaggagggcgagcagggtagaatgagtactgtccagtgagtactgtccagcagtgaccactattgtgccccactcctccctttcagaatagccgttggcatacagtaggagctcagtgagtgtgttgactgacattcgatctcatacacgcatgacccactgcattgtactctcacgtccacagagccctgtcattgtacccaggctccagatcttagaggcataagtccattttccacttttttttttgttttttttttttggaaatggagtcccagtcgcccatgctggagtgcagtggtgcgatctcggcttactgcaagctccaccccgcgggttcacgccattcttctgcctcagcctccccagtagctgggactacaggcgcccgccactacgcccggctaattttttttgtattttcaggagagacggagtttcaccgtgttagccaggatggtttctatctcctgacctcatgatccgcccatctcggcctcccaaagtgctgggattacaggcatgagccgccgcaccggccccatttgccactttataggaggagcttgtttacccttccctccagtgttcgagagtattctgtcacaggggagtgggtggcagtgactggattgtcagccttgtgccttccagaaaaacaagaattcattgtgctgtctccacccagtgttgaggatccccccccccatttcttttggtgaatggagcctctgtttctaacaactctcagcctttgaggggcttctgactggattctagaccagtctggaaggggccgcctgagaacaggtatacctcagggctagtttccatccacaggaagaattaagtctagttcagttaagcggtgtttatcacacttctactccacagacctttttagagtctctaagaaatggacatagtacctaatgcatgtcccagagaggcacacccagggatttggggagtcacacgtaggcagactccatcaactgggggatcagtaaaggcttcgcggaggagatgatgtcttagatggtcaagaggagtttgttggatttcagcagagaagaggccttgtgggataaaaagatgtagagatagggaggtgtgtcacggagctggagagtggagggaagggtaggacaggagtgacaggaggcctggcatggcagaatgaggacccgaactgcgactgcccctccacttacagatgccatatgcaagagtagcccaccagagcagtttctgggtaatcaagattaatgagccccttcccaaggcacacttcttacagctgagtgctgtgcatcacactatctcagatgcctgccgcagtcactgagtctatcctcatgtgctgtttgggccacaaatgacaaagtgttgtcttcctgttagatactactctctgagttttcttaaatcaacagagtcccatcccccagctatgccaaatatgtgagtcatggacatgtatatacatgggaatggtgtttatattctgctccccaacagctgaggagggtgggataatagtgcctggtgggcagagcgccaggagcagccctgtcctgcgtgggggtgtgagcggatgctctgggcactggtggtggccggaggagcacgtcagatcagcctggggaactttgagggtgtgccaggtgcctgagtattacttgtttgttgttggaagacaaacgtatgattcatctgcctggggtatgaggaagttaatcctgcctatcggcctctcctaaccttggtcttgttttctggcaggcagaggtggaggagacactgaagcgactgcagagccagaagggagtgcagggaatcatcgtcgtgaacacagaaggtacgccctccctcccgccatgacccgcacccaggcaggcccagaagcagccataacacagcatagcacttgctgttcactaagcccttcatgaatctgatctaattttaggcctttttaatttttaacacctccagtgttcttttttttttttttttttttttcattaaggctagtcaggtgaagcagcgggagtggagaagggacaaagaaatcggtaactggttgtgagcaattagttgtaaactgcattcagaccagccacctccagtgtcctcacaaagggaaaatccgctcaatcccaccaccctgacagatcacacttcagtcttccatgcttactcagcctcgtccagcacagttccagaggaccataatcatagttgttacccttgggcatatgtttacacttgagctttttaaaatattgcttcatggtttacataaacaaattaagtgccacgacaatgttcattagcccaattttgttgtttctactttttagtaaatccattaagtggatattacatccccatttgtgttgattctgctttattggctggatagttctctagttaactcctctgtgcctgcagctcccctccaccccaacaaccctttctgagtggtatctgtgtaggtagaagtgtacagatactaactttcccagactgcactggacaggaagggagctagcatttatcacatacccgctctgtgccaagattctggctggtgcagccctgtcgtctgcattttgcaatggagaaaactgagtctagaaatgtaattgatcggcctaccatcacacagtcgagatttaaatccaagcccgtctgagtgcgcttgggtgctttctcccgcgccaggctgtaaagaaccagaatggcccccagaccctcacgctccaggcagcagtaaggacagggactctggaatccagcagttgtgagtttgaattctgcctcatctcctgactagctttgtgaccttggccaagtcgcttaagcctgtaaatggggataatacttatatctaccttataagttgaagagtaactaagaatgaacagcgtaaagcatttagtacagtatcgtcaccatctgttttgagctgtgaggcatttgttcatacaaactctgatttacctgattgggttcccctgttgggttgggagcatccacatgcttcatgcctctaggccacagtgtttcccacacgtattcattctttgaaatcacccgggggtcctgttaaacatagctttccaggcctctgcaccaaaaagtctaatttattagagccaaagcaagacctgaggaatctgtgtgtttacgaagcaccccaggagattcttatgatcagacaggtttagaaaattctgctttaggggatagattctaatcagaagaggctgcagtgagagccacaggcctaagattcacagcagttctgtctccttccgaaggccttcccttggagagactgcctcagatcatgttttcagggctgtggtccttaaacccaggggtcctgtgctaccctgggagtagaggtagaggctggggttcctgtcctccacttcagtcagagcacacacactaagaaccatcagttcatgtttctacattggttttaatttggaaaggggtttggccaatttaaaaactaccctactggagtagccggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcgggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaactaccctactggagtttacaaaaataacataaaccagtttatgtgagacttgggaggagaggagtccactgagacactgctgctgatagagcagcgtgaccagtgaaggaagaccaggaccatgcctgactcacctctgttcccgtgtcattcaccacaggccgcagagtcaggtcagtgaacgttaaatgaaccaaccacagtgggtgttgccatcagcccctttgatttggtaattcttgaggactgtgttgagaggaaataatcccaaaggaaaaaacctgaaatttttgcaagcatgttagatgccataatcagtagattaataattgttataatggctgggcgtggtgcatggttgctcacacctgttctcagcactttgggaggccatggcaggacgattgcttgagccaaggggttcaagaccagcctgggcaatgtagtgagaccccgaactccacacaaaaaaaagaaaaattaggcaggtgtggtggcacacgcctgtagtcttagctactcaggatgctaagacaggaggattccttgagcccgggagttcaagactgcagtttgcttcaaggcttcttgctcaaagctttgattgcactccagcacagagcaagaccttgtctctttaaaaaaaaaaaaacaaaaagtaacaatgaagtgtgtaggcccttcagtgcccagcccaggggctgctcccacaggccaggatttaccagcagccctgtgggtggaagtggtacagcagtgcctgtgtctgtcacatgtctggtgtgctgccaggcacggtttgtttatgtgtttcttggctgcctcgtagggtagacattattgcggccacctttacagacacacttggacatcccaagaggtcaggccatgcccggttgcggggccccccaaattctctagcccagtgtattcagtgggctctaatttgttcagtgctcttagagagcctcttatgtgtgtcttcagtctaggccttgttttggagaagcagagttctcgcaattcctacttaagcagaatgaaagccatcaagggcaacaaagtggaggtgctgtgtccttggatagaatgttgatttccagccaggcgtggtggctcacgcctgtaatctcagccctttgggaggccgaggcgggcgtatcacctgaggtcaggagttcgagaccagcctggccaacatggtgaaaccttgtctctactaaaaatacaaaaattagcctggtgtggtggcgggcacctgtaatcccagctattcgggaggctgaggcaggagaatcgcttgaaccaaggaggcagaggttgcaatgagccgagatcacaccactgcactccagcctggacgacaagaatgaaactcggtctcaaaaaaaaaaaaaaaatgttgatttccaagtcagcagagccctggcaagcacagagctagacagaacgtgctccccagccctgtctagttctgattaaaccatgtggtcatttcatttacaggaggctgggagcccttgggacactgtggagacaggagcaggccccctgctcagggctgcccctgatcagttgggtggcctgaggcaactcctttccccgcttcagccctcaactgcctcgagtcctgtgatggtccagggaatctcttttgggcacttcttgctctaagacctgaaagacttttgtcactaagagagaaactgtcttctgggactggacattttgactccaaggagacaaccccaggggccaacagccccagctgtgacccccaggcttccacatgaactcacaaaggagaggccctcattcttgccttaaaactgcccctaaagccaagccttttcactgggaagccctagctgcttaccttttggatactagtgagtgctgcttttttgtatactcatggggctgattgcaccatagctgagaacgtggaatgcagaatgagcccacctggctttgaatctgggccctacttaacttatcagctatgtggttttgggcataagccactttctctgttaagttttctcatttgtaaaatgtgggtcataattctgccttcctctaggggaagcttttagaatagtgcctggcatgaaatgcctatgaatgtctcagttagtgtgtgtgtgtctttaacttgcgtcccattctcagggcccccacatcagtgtctcgtttacatctcacacagtgaccctgcgaggcaagggtttgcccagtttgcagatgagaaacccaaagctgagagaggtgtggggaaccgcccaaggtcacccagctgtgaatgaacgtggtcagaacacagaatctgagttggtcacacttcccactgatccatggggcctttaagccctctggaagcttccattaaagatgattatttgaggataattgtattgggatgcctatgatcttatctagggttttcctacccatccccaacattcagctcagctgcctctttcttgaggacaccctcactgatcaccccagcccagccagagtggttgctcctgctcctgcccctgaacctatgacatacccaagtcccaatactttcgagccatctgccactgccttttgacatctctgccttggctagattcaaatggtgtttcataataaaagtctgagtttaagcagctttaccgaaaacgcaagggaagtttcattccatttatacttctccagaccccctgccatcctctgctgctacccacacaggcagaataaaaggcttaaatgtgtaagtcccatgaaggcaaagattggtctcttgtgttcactgctgtctgtagtacttaggatggtgttggcccagagttggtgtttgattaaagtatctgttgaattttttagatgttttttatcacttgaagggactgggtgtggtggaagggcctgggggtgtatcccagtagatcagagccccaagttagaaatcgtgcctcccagataaccagctacttctgcaggctacacagtgttcatttgtgaagacagaggcagggagcaggtggcctaataactaggccgtctcaggtctcctccagctccagcatccagtgaatctggaattaacctttgtccttgttttaatttcttcccggttttggtccttggccctgtacttccacgttttcttttgtttttggagtgagccagtagatgtttagtttcttgtctgttttacacagctcccgcttatatggatgtgatcagactcctcatgccaatatctttccaaactagtaaaagtagaccctttgaccactcacttaccaatagcaataaaagcttaatgctgtctctctagggacactagtgagcaaatcagacttggtcaagcccttggggagcttacattgtggtgggagatggaataatgatcactttgtaatggtgcagtgtcaacctggaaaaactgcgtggtgctgggatggtgccagtggggatgggaagtgtcacccgaagatggagacctcagggaccaaagtggaaatcatgagtgaataggggaaggaaagaaagttccaggcagagggatctgtgagaaggtggcttcgtggtgtgtaaaaagagaaggttaggggttctgatcacccaaaccatgccaagtcttgggactgtgggcctcttaccattggggcccaaaggtgagctaaggggcgggttcccggccaggtagcaagaacagccaacccagggctctacctgggctctggtcctggccctcggtgggtgggctgtgttttagcaaggcccttgcgggtttaagcaatagtcacatcccttcagatgaatggaaatggcatttactgtgtgagtggtgtttattaacatttattaagtgtactcttgctaaacattcttaaatgaattaagcagtattcagcccgcccagcagcactttgaagcacagatattatttaacagataaggcagtggaagctcaggaggtttcatcacttgcccaaggctgcatagctgtgaagggcagagctgggtgtaagcctaggtcaatttggagcccaggaccctattaatctggtccatagctgcccagcctaggacacgactaaaggcattcatcagactgacttgctgggtggcaagaaactggcccagtcttgttttcttaggcccccaggaatgcgagggtgggcagaaagagtcgtggtggctcctaccccatcgccgccccatcgtggttagattataatggacgcattcattactgccatcctcaggaagcttcaactgtagagcaaggctttgcggggccctgccatgcacattgtggccatccaggagccagcagcaaccctggtgatctggtcatcttgtctcttacagacaagtgatgactgcaacctgttctcctgacttgacttggctcaaaaagcctctgcgactcacctgcttcttttgccaccatgtcctcttctgcccaccctcacattcctggtgccctaggatgacaagattgagccagtttctttaccactcagccagtcggcctgataactgcctttggccgatccctagactgagcagctgtgggcaggatgagcagggtcctgggccccaaagctggccacttctatgtgaggagctacttgtgccacattcctcaagtgcctgtcagctggcgggctcttggggtcccatggatggagtcttctgctcatatgtcacaggcaattcacaggcacctgctggcccaatcatgacctgcggtggctcagtgtgagccgcatgcctcacctctgtgacagtaggcaccgtccagtgaataagtccacttaatggttcatctcaaggaaacagtcctcaaacaaaaggcttggtatacggtgatgttcactgcccagttaattatactggtaacaaacccagcccctaagtagccaacagtaggggctggggaggtctgtggaccgctcacctagtgggctctttgaaagagatagcagtgctgtttacaaagggtcaacatgttccatgtttctgtgcctgttgtacaaacatagaaacatgctttaacttggcacggccatgtggacagtgtgtttatagctgctacccaagcctcccttgggtggaaatcatgatggttatgtcccagcacaagctgactttttctcttctactttttagtgtgtagaagtttgtggccgggcgcggtggctcacgcctgtaatcccagcactttggaaggccgaggcgggtggatcatgaggtcaggagttcaagactagcctggccagtatggtgaaaccccgtctcttctaaaaatacaaaaatcagccaggtgtggtggtgcgcgtctgtagttccagctacacaggaggctgaggcaggagaatcacttgaacctgggaggcggaggttgcaatgagccgaggttgcaccattgcactccagcctgggcgacacagcaagactccatctcaaaaaataaaataaaataaataaaagaagtttgtaaggcagggtgcgatggctcacgtctgtaatcccagcactttgggaggccgaggtgggcggatcacctgaggtcaggagttcaagaccagcctggcaaacatggtgaaaccttgtctctactaaaaatacaaaaattagctagctgggtgctgtggcacgcgcctgtaatcccagatacttgggaaactgaggcaggagaatcacttgaacccgggaggcagaggttgcagtgagccactgcactccagcctgggcaacagagcaagactccgtctcaaaaaaaagaaatttgtaaaagcgcttcctggtttcaattctaagcactatgaatgagagtctctctttttttggacaaaaaaataaaaacctgattttgttagttttttaaatctgtgtccctgcatgaatcagagctagtctctccttttactgctgggaaccaatcagccctgggaaaggaacccaggagtgagccagcaggcctgcatgtgaatcctggccccactgtgtgactacagacaggtcgcctcatcactcagagctcctgttgcctcatgggcgaatgagatggtgttgccacccacagagtagttctagggcatggcactggcatgcttcgggtgctcagcaccatgcctgtcacatagcaagccctctgcggatggtggcattgactgagaactgctattccagttctccccaattaggggtgtgggtgggagctcggcagaaggggctccacatcctctcagtctccgtctgctctcccctcaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccaggtaaggggtcttctacctccccatgtaggaacagacctcatggcacattctctgtggctcatcaggagtcctggcacagtggtgtctccagaggatccaagcagggcccgaggagttgaaggaattgggttgttgcctcactgcctagccagcctccagctggtgtcccatagcagatcctcccagggaccggccccagagggtaaccccagtctcctgagatagacagacacgtgagcatcatgtgtgtctccccttccttgataggagaaaactcaaaggcatttgggacatagaggagggtgtggccaggcctgtctggggctgtctgcaaaagcttcccagaagaggggacactggagctgaatcttaagggcaccaggaagcagtgtgagcaaggcggaggggcggaaagccacgtttggaagaatattcagtgattcttctccaaaatgtaaagcaaaagtactgtatcattttatccttgaaaacatgttctctgcccacttgtaaaggccaggcctgtctttaggccccttacagccagcttttcctgccgcacgggagcagattgctttgtttcctttacgcgaggtgcttgccttgcatttgggggctctgtggtgcaaccaaggcctgtgtttagtccttaggatcattctcagggtgaggagatgctcattctgggaggagcccacaaggatgggagcacaggagcgagcaacagagccacatctcctgcccggctccctcgctctcactcatggactggggtggcaggcagagcctccagggccgtctttgcattattacttttttctcactctgctttttcttggctgagccacatagttgagtgtgcgtgcgtcacgtatgcgcgtgatggtgcactcccgctgcagtgccgcttatctagggcatcaggatgtgagtggggaggagtgggaggtgaggctttggtccagtttagaaggggccacaaacacctaactcagttgcatggacttgatcttgcaagcagaggtttttagggcaggaggtgataggattatgattaggacctggataaaggaaggcagtggggggtctggggacactgaatgctctggactggcaacacagagggcaaggaggctggccacagagttctgaggtaatttgatgggaggtcagccactccctgcagcagaccagcataggttctgtcaccaggcctggaaggatgggcaggaaagaactatagagccagtcacagcagcccacaggctccctgggacactccctagaggggtggggacagagcagttcagtcacagagaagaacataagaataactccagagtctattattccaaaatcacgcttctgtgtgtaatgcctgatccatcggggagaaaagactgcaggaggcacagaatctgttttcccagctttgcttcccacaagcatgaccctgggcaagtcgcagaacacctgcaaatccacatctgtaaagtgtcgagtaggggactgtgctgtgctgatgtcctgagccaccctgcctggttgagtgtgttgacctgggttgggggaaaaagccttggaatcagatttaaactgcagttcctcccaggttgtcatgttgtgtgactgcagaggacaaagcttcactccccaaaagtcgggccgggatggagcgcagtggctcacgcctgtaatcccagcactttgggaggccaaggcaggcggatcacaaggtcaggagttcaagaccagcctgaccaacatggtgaaaccccgtctctactaaaaataaaaaaattagctgggcatggtggcgcacacctgtaatcccaggtacttgggacgctgaggcaggagaatcacttgaacccaggaggcggagcttgcagtgagctgagatcgcgccactgcactccagcctgggaaacagagtgagactctgtctcaaaaaaaaaaaaaaaaaaaaagttgggccgggaacagtccccctgctcaccctgtgcacagcagaccttgtgctccccagtggcccactgggagttcagggtatgggggaagggagcaaattacttggtctccaaatcagacaaattctccacagacagtgtcccttggcataaagctcctgagaatgtctcctctggaaggacagtgtcatctgaaagctcctggccattcaggtctcaacttggcagcggcagcgtctccaatttggccctgaagacccacaggcattcagagcccatgactgtggttggtgcttgagtccagaatgggcagctcccaagtagggggttctccttggggttcacaggcctggagatcccacaaccttgtcagtggaggaggatgaggtggccagtccctcaccttggcagcactgcagggggcgcccgtgctctcaagtcacactgtctctctcccacacacatgcggcgctgtgctggaggacggtggcgcgctgagcttgtcttacagagcatgcttctttggctcagcctcactgctgccactcaagtccttcctcgtcaccaaatgcttacctgcatttttaaggccatctactccacttgagagtaagttctatgagggcaggggcttgtaagcacatagtaagcatctagcaaatatccattgattaaataaatgaatgactctgtaaacctccctccactgctgacaccccactgatatgggtcagaagtggggtcagcagtggggacggggtcagggatgtctgtggggcatagttttaggatgaaaaccagtgatttgacactttgacatacccacttttatgtggccaagaaaaaataattgggttttggtgccagaactcctgtggtcaggagccaccacgcagagcctaggaggccctggcgctgaattgcctcaggatggctacagaacacaggacccaggggtggccacaggcgtagagcaggcctggctgctgctggaagtgcccgtttgagactgtagttagcaccctacacatcgtgggcagcctggagcagcctggcccgggagggagatccatgccttcccacctgcctgacctgaccccatccagctgaggtactgcttcccaggctgcagacagcagcaggtgttccagacagtgtggctctccacatgtgtgccacattcaccccaccctggcccagaaccgcccacgtgaacaggcttttttttttttttttttttgagacagggtctagctctgttgcccaggctggagtgcagtggtgcgatcatggctctctgcagcctcagcctccctagtatactgctgggaccacaggcatgtgtcgccacacccagcatttttttttttttttttttttttggtagagacagggtttcactatgttgcccaggctggtgtcaaactcctaggctcaagcgattctcccacctcagcctcccaaagtgctgggattatatgcgtgagccaccatgcccggccaagacattttaacacaaacttttgttagctggacatggtggcaccagtattcccagctactcgggaggctgaggcaggaggatcgcttgagcctgggcagttgaggctgcagtgagccatgatcacgccactgcactccagcctgggcaacagcgagacccagtctcaaaaaacaaaacaaaaaaaacagacttctagttttcacttattaacttcactagtattaaagctgaggtaactaactcagcctacacaaccttcaacacacactacctctcacaaagcacctgaagtggtattgttgcatttagggcttgatgatttggagtaaaagacactgatgttaccgattgtgcctatttttatcagtggcttgttaattatttctgttttcattagtgatttttatgtatgcagattggttagccatgaaactgttagtcacttcatttctgtttcttccctgttgcaacagcccatcttcgtgggaagaaccaagctttaggcttggctctgaacagccacaaagtgacttggctgaggtcctgccatttcgctcatgctcagcagggggcagcagaccagggcagttcagagtatggggtcaaacccaggtccctgtccccactccacctgtggatttaccctggattgggcaagccctttaactctctgaggctccgtgttctcagagtgactcgaggattcactgaggtgccgtgtgagaagtgggtggcccagacctggacacaaagaagccttgatcaatgtttgcagtttgattaagtgggtaaatctgcatatataaaaatcactaatgaaaacaaataattaacaagccactgataaaaataggcacaatcggtaacatcagtgtcttttactccaaatcatcaagccctaaatgcaacaataccacttctccagttacctcttcagtgaaacgggaggcactcaggctcacctccaaggacttggacttgctgtgatttaatggtggacattcctccttacagggccagatccctggagctggaatccaggctgctttgtcccattttgaaattttcttattcagaaggttctggaaagccaacaaattgagtttgtgacagaaattgacattaactggctgggtgtggttgctcacacctataatcccaacactttgggaggctgagacaggaggatcactcgagcccaggagtttgcaaccagcttgggcaacatagtgagaccccatctgtacaaaactttttttttttcttaatggagtctcactttatcacccaggctggagtgcagtgaggcgatctgcaacttctgcctcccaagttcaggcagatctcctgcctcagcctcccaagtagctgggattacaggcacctgccaccaagcctggctaatttttgtatttttagtagagatggggtttcaccatgttggccaggctggtcttgaattcctgacctcaagtgatctgcccaccttggcctcccaaagtgctacgtgagccaccacgcctgaccttctacaaaaaactttttaaaaatttacccaggtttggtggggtgtgcctgtagtcccagctacatgggaggctgaggcgggaggatcacctgagcccaggaggtcaaggctgcagcgagtcatgatcgcaccactgtactcagcctgggtgacagagctcttgctctgtctcgcggaggggaaaaaaagagagagagaaaaaagaaaatgacattacccaagtccagtgaagtatgtcggaattccatctttgacactaagtagctgggtaaccttaagccagtggtcctcccacagcctacaacatcagcatcacctgggaacttgttagagaaatgcaaactcttgggctttgccccagccccactaaatgatggttctgggcgtagagccctccaggtggttgggatgcctgctagcttgacaaccatggccttaggcaattcattggagctctttgaactggagtccccccacctggaaaacaggggtgagaatcctgcctacctgctgccactgtcgtggggaggattagaagagacgacacactgtagagtgcccgctgcccggtatggggaggcccctcttgcaggagcccctgcaggaatcttaaaggtttatcttccgttttcccagcatttggagatgctgaacgttgatgctttttgttgctttctccccttcctcattttatggttagtgatttaatggtttatttgctttcttgtgtgtttttctctcattttacatttagtgattttttttcatttttctcttttgcagataaagactatttcctgattgtgattcagaatccaaccgaataagccactctcttggctccctgtgtcattccttaatttaatgccccccaagaatgttaatgtcaatcatgtcagtggactagcacatggcagtcgcttggaacccactcacaccaatccagtgaccgtgtgtgggctggcggctcttctcccccaccaacggaacccctgtgtgcaccaaccttccccagagctccggagcgccctctcctcacttccaggttttggagcaagagcttgcaggaagcccgcacccagcttccttctgaccttcagttcactttgtcgcccttggagaaagctgtttttctttaactaaaaataaccaaaatgcttacccgtctgttgtgtctttaaacactaggttgaaaaggcctcactcttcctgtgtaatcacacgtcggaggcccggttgcctcctccagccctggtgggagatgatgttcatggtgtccgagaggcctgctgcttcttgtgcctgtggccatacttagtgtagcttggtgtataattggtgctctggtttctgggcctcttggccctagtccttcttttactgtttcccactgctgccagtgttgaaagattttttctactatgctgcactggggaagagagtggtacttactgaggacccggaatgcacctggcgtgtaacatacagtagctctcacctcacggtaccatctgtagacagagtgttagggccacctcagacatggggacttgggtttagaatggcttacctacgccctcacagccaggacacaggtctcagactcaaatagccttgctcttcccacactatctgccccagaaatcctggagggcccccgttcacccaagtgagcctgtcctgggcaaacatctgccccgcagacttggagcgcaggggtcctctcgccgagtgcttcccagaattcacctgcactcagactcccacccacccctcatccagccacactcttgtttttttccctctgaaaccacatgtatttaattttattagggtttttctttttatcttttgtttcctgttacacaggaaaaagactcggcaccgtgtagtgtgagcctggaaatccccgtccttgtcctccctgccccagaagtcaccactgtctgtgagttcttccatctagcaatcataattgcccagattttccagtgaggcttcctcaatgctatcggaggagtgaaatacatactctttggagttgaggggtgtagtttataagggcgtggcaaaatttcttcaaaagctactttaatgaaagataataggcattttccactctataatatattcgtgattatcttaatataaaaataaccctctcaaatagttttccctgaatcttcaagtaacgttggttgtctgagaaacactctggtttcccctgtccctgcggacctaggaagcgccccctgagagtgggtgactgcagaccccacgtggtgattctctgctaagttccgtgctgcagacgaacgtggggtgtggccagcagcgtcacccttgtgttctcggaagctgggatccaagtctgaggctcctccgtccttctgcttgaatttctccaagaaggataatggggaaggaggtcggaggaggagaggtcaggtttctaggacggcgatcgggggtctgtccctggagggaggaggcgttctggctccaaagcaagggttcagaatagggctgagggcctgtcccttccaccttcccttagtccccctagtactgcctcttgtttgccttaaagttccccatcctaaaagcattccatcaaagtcttggggaaagtttcttatgaaaataaagatgctccacttcccagtcccttgagcaccaggattttgtacatcaggagcccaccatgtacatcaggagtttgtaatgcagcaaggcaagcataattccttggactcaagatgtaaaaatctggctgggtgcggtggctcctgcctgtaatcccagcactttgggaggtcagggcaggattgcttgagcccaggagttcaagaacagcctgttgcgacatggcaaaaccttgtctccaccaaaaatatgaaaattagctgggcgtggtggcacgcacctgtagtcccagctgctggggaagctgaggtgggaggattgcttgaggttgatgctgcagcgagctatgcgtccaccactgcactccagcctgggtgacaaagtgagaccttgtctcaaaaaagatgtaaaaattcatggccacagagaaggtttacagcgggggaaaaagaggttaaaattaagttttgttttttgttttttttttgagacagagtctctctctgtcactcaggctggagtgcagtggcgcgattttggctcactgcaaccgccacctcccaggttcaagtgattctcctgcgtcagcctcccaagtagctgggactataagcgcccaccaccatgcctgagctagtttttgtatttttttgtagagatggggtttcaccatgttggccaggctggtctcaaactcctggcctcaggtgatccgcctgccttggcctcccaaagtgctgggattacaggcgtgagccaccatgcttggccaaaattcagatttttaagaatctaaataatggtattccacatacaaaaaccctagtgtttctgtactcaaaagtagcgtgtatactgtcaaggttagaaactgacagctgtcctaggcctagagggaaaagcatgggttctgagtttcagaaggacatttgccaatatagcaaaggtgtgcccacacccagtatttttttatgaaaaatttcaaacctacagagaattgaaataattgtatatcttccatctcaattctacagttacccattttgctatatttctgtatcacataactttccattcttccatctaacttattttttatggctttctaagtatattgcaggcagtacccaccccaagcactgccaagtgtgtatcattaactagtttgtttactgcttttggaggatgggtaagatttacatagagtaaaatgcacagatcttcaaagtgacaaatgtgacccctgtgtaacctcacagccgtttcaggaaagctgctgctgcttcccagtcggcccagcccactccccagaggccaccctgttctgatttcctccaagtatgatttctgccctctaaggtacagctctcacctgggctccgtgagcagggccggcgtttcagggaagtggcagcttctcgggaggtgccgcagctgccatctcccgtcagcactcatgcctccgcctcagccctggccacggctccctggaattctgatcctcctctgtgagctggtattgctgtttctccaaaaattaaaaatgctcaaaggattataggttttctcctctttcgtatgtttggctctgagacactgcatgttggcacgtttttcattgagaatcctgaaagccacctttccataccaaattcccatctgtctctaccaaattaccagaaaaagaaaaaatgagaaatggaggtctcagattccgtcatcacagcaggtagaaatcaaagtcactgaatccatcaaattagtaagcataccccactgtcagtgaacttcagctgatcagttatgtattgagaaggcaaataacacaattgcagaacatgttcaaaatactagtcctactgctatggtgaacaagctcaatccaatcaaaagcacctttattttggtctctcactgtctaaatttactctctagggcttgttctcccgctgtccctaggtgagatgtagagcaagccctgccctgggcagatgaagtccccgcccaacacaggaactactccttccagccgcgtttggagagaggccgccccttccactgtgggcccgcggggaacctcgctctctgcagggggagagcagcttatgtttggcctcggccttattttatttgcccacttggtgctgtcagctctctttcccaagttgctgagaggggcatgaggtggggagcagaaattcatcgttcgccgatactgctgtgaactggcttcggccgtggtgcattttcatgcgctttgacacgcatgccccctgccctcttctgttggtagctccctcactttgaagggtgcgctccttctggccggccctatctttggctcctggctgtcggggtctcccctctacacactctcttctgttgagtcgtggtgaagcagaaaccccaccgccttcctccatgggttacgataagattcatagcctctcggtggcctctaaaaatcttcctcgaacttccagctcctttatagaccacattcccagcagaagtgtgagctcgcttgggaccacctggtgtcacagtccaggctgctgctggtcctgctcctctacgtggcaatcggcccagagaatatgccttggggggtctcagcagaaactaagatgaaggtaattcaacttcaactccctagttcacaagaaatacgttagctgttttccctaaaaaaggctaggtgaaatagggaatttcatgattttttgtggggggcagggggggtacacaatctccctcttttcacccaggctggagtgcagtgagtggcctgatctcagctcactgcaacctctgcctcccaggttcaagcaattctgcctcagcctcccaaggagctgggattgcaggtgtgcgccaccacacctgggtaatttttctgtatttttagtagagacagggtttcaccatgttgctaaagctgggatccaactcctgggctcaagcaattctcccacctcagcctcccaaactgctgggattacaggtgcaagccaccacgcctggcatatttgatttttaaatactacaagtatttgggtaaaaattaaatttaaaaagtttgcaataacctaacaacaggctataatatgataagccaggggcttcccagcccttttctaatgaagtaactgaagaatgaggagcgttatctagaagtcagggcgaatctgccagagtcaaccaaagacagccccctgcaaacatgaacctgctctctagaaatgtacacaggtttgcgtcccggtggctccggggagaatgtggagccgagtggagtcaggagcgcaggcagccaggggagaactgatggtggcttgggcaagggcggtttcatggggtcggaaggggggattctgaagggagaacgccaggacttgctggggagggttggaaagtaaggaaatgagacatcaaaggagactcctccatgcctgcttgggcaaccaggtgctgccatttactgagaggaggctgactggggacctttgtggggaaagagcaccagcaatttggaaatggcttaatctgagcctgtgagatacccatgtgtttagaaagaatgtcggatggactgttgaatacccaactctgccaggccttgctagacataaggatatggagctatcagcctgttactggtatttaaagccaagaaggttaggtgcagtggctcatgcctgtaatcccagcactttgagaggccaaggcgggagattctcttgagcccaggagttcgagaccagcctgggtaacgtggtgaaaccccatttctactaaaaatacaaaagacagccgggtgcgatggtgagtacctgtagtcccagctacttgggaggctgagatgagaggattgcttgagcctggcaggtcaaggctgcattgcgccactgcactccagcctggccaacagagtgagaccgtgtctccaaaaaaaaaggttgtggaggctgggcatggtggctcacgcctgtaatcccagcattttgggaggccgaggcgggcagatcacctgaggtcaggagttcgagatcagcctgaccaacatggagaaaccccatgtctactaaaaatacaaaagtagccaggcgtggtgcacatgcctgtaatcccaactactcgggaagctgaggcaggagaatcgcttgaacctgggagatggaggttgctgtgagtcaagatcgtgccattgcactccagcctgggcaacaagagcgaaactccgtctcaaaacaaaacaaaaaaagcttctggagccccagttatcacgttcaagttccagatggcagctgatggaggatggggatggcaaaggatgtaccttttccctttaaggcaatttcccaggagtcccatagggcacttcctacttaggcctaattaactgaagttcagccacctgccactcctgactgcatggaagccaggtgcaaggagaaaggattttgaggaggggtgagtcaccagaacacatttgtttgctgcggagagatcgtaaggggcctcggagcaagtccatggggcgtgaggagggctggcgtcctgcgcacagtggaaggactggccttaggaacagggacagtgattccactcagcatagccagggagcggcccagatggcagggcaaggtctctgtggagtgagggcagcagggaaggtgcctcgcaggagaggagagaaaacatacacttccctggggacgcgggcggggagtttgacgggttcggcaggtggcccttttgcagcatctttttcagccgggggtgcagcagtcaccatacagctgaactcggccaggttaaggcggcagaagaaagagggagttgggacttttggaagtaattatgatggctgtggagtctgtgctgggtgaggaagggaagtgactggatagagggtggcagtggaattttttttttaattaaaatttttttcttccccaaccgctccccaccttttttttttttttttttttttaaatagagacagggtctggttatgttgctgatatggtctggctctgccccacccaaaatctcatcttgaattataatccccataatccccaggtgtcaagggagagcccaggtggaggtgattgaatcatgggggcggttcccccatgctcttcccgtgatagttctcacaagagctgatggtttggtaggtcctcctgcgttcattctctctcctgtcgcctagcgaagaaggtgcctgcttccccgtcaccttcctccaggattgtgagtttcctgaggcctccccagccatgcagaactgtgcctcagttaaacctcttttctttgtaaattactcaggctcgggcagttcttcacagcagtgtgagaatggacaaatagtttcccaggctggtcttgagctcctgcggcctccctaaacgctgggattgcaggtgtgagccaccgcacctggccagaatgaaactttggaaggggctgattgttcagataggcgggggtcagtgtgctcggccttgcttctgcaggggaggcacactggtgaggtgccctctagggcagacgagggaggggggttcccggagcagtgacggtggagacaggtgggacgacacagatgggcttgagaggactcaggactgcaatggcaggtgagggggagtccacctgggcctggaccaggtgatgggatgagaagggagggggcgattagctagaggcacaggcttggggaaagagatgacttcctttggacgtgttgagttcggaggcagcctttgttccagagacagagcctggacctgacagctggaagccaaactggaggtggggattgtacgtcactcatagtggaggcactggtgggtgtggagagaacccaggaccccatgagtggctggaggctgcgaaggccgcggggagccaacctccccaggtgaccagaccgctccaagggcttgaggtcacggagggagaagggtggcagccccggccctctcactcagggaggtggagttagagctggagaggcctgagcacgcccctggctcaagaggaggacagatatgcgggtgaggcccggaggaagggaatggccaggtctgaggccctgcatgggctgtggggttggtgttctcagcctccacttttccagtgaaagcagaggatctgtggggagcaaggtggggcagtgtgagctcgaggccggaggacccctgagtgggtctcagtccctacaatctttggagtgttccccttcgctgccttttttttttttttttaaagatggagtcttgctcttgtctcccaggctggagtgcaatggcacaatctcgactcactaaaacctccgcctcccgggttcaagcaattctcctgcctcagtctcccgagtagctgagactacaggcgcccgccaccatgcccagctaatttttgtgtttttagtagatacagggtttcaccatgttggccaagctggtcttgaactcctgacctcaggtgatccacccacctcggcctcccgaagtgctgggattacaggtgtgagccaccatgcccggccccactttgcttttttggttgtggttttttggttttgtttttgttttgatagtctctatcacccaggctagagggcagtggtgcaatcttggctcactgcaacctccgcctcccgggttcaagtgattcttctgcctcagcttcccaagtagctgggattgcaggcatgcaccatcatgcctggctaatttttgtatttttagtagagaaggggtttcgccgtgttggccaggctggtctagaactcttgacctcaggtgatcagaccaccttggcctcccaaagtgctgggattacaggcacgagccaccatggtcagccttcactttgagtctgtaaacgggaactgccaatccttcctcggagataatgaccctgactcagacttcagcccacgtgtcctcccgatatgaggcccatttttacgagttcatcaccttaaacgaggcgccaagtcacagcggtgttgatgcagggcaggttctttgcctggctcaggaaggaattcaagaaccagccggtggtagaagaaaacagcttgattgatggggtggcacgttacggctgtgactggccccgccatgggcagtgtgctgagagtagcagcccagggacagatctgaatccgtgcttattcccatttttaatgacatcctaattcagggggcgggttattcagaaatagctagaaaatgggcggtaacttttgagtgttgccatggccagaggtggtaacttccaggtgttgccatggcaatggtaaactgccatggcactggtgggcgtgtcttagggagaggtgatttcagcacttctggttcagccagtcttcaatctcgtccagagtcagtccctcctgcctcctgcctccgtgctgattgcaggccctgtttcccccaggactccatggcttccgagttgctgactgaccctccacctcagaggtagttctgacactgtctcagttttgcagatgaagatgagattcttcagttctccatgtggaaaagcagctgtggacccaggtctgtctggcccgcctgccgttgtgtgaaggagctcagggcctatggtctgtccacactcgcggtcatcagtggccaagcaggccagggttgctccgcccgtgtgccaggccggccaaggccagttctccactttttctcaggcccatgggtccaagtccgaagccacagaacggcaggaatgaggggtgggagcagagcagtcgagggtgcgcttgaccgtggctgagaccccctgagcagaaacgactcccccaacctctgctgatcctcctagcacccagcagcagtgcttggcacagactctgtccctgcgcatggtctagagggggagatagaccttctagatggcaaacggcatggagagatgactgtgggggcctgggggaggggtcacttatccaaataataattactgagcacccaccatgtgccacactctaagtcctggggtgtagcaggaaccaagcatatgcagaactgcccttcaagggcttgcactttagtgagaaggaaataaaattttataatattaaatgtaaaaccacagtgagataccactacacacccgccaaaatggcgaaacgaaaatgaacaccaccaaacggtggcaaggaggcagcgcacctggaactcccgcacatcgctgatgggagcacaaaatggaacagcactgaagagaggcctggccactcctcaaacacacacctgcccccaaagccagcatatctcctattcgtccaagtgaaacaaaagaacatatcccttaaagtataattaaaaatatatatatatccacacaaacactgtcacagaaacgttcagagcagttttattcacaatcaccaaaagctggaaacagcccaggcatccatcaatggaaaaactgctacatccatccatgggaacctacttgatagtttaaagaaatggcctacttgggcacggtggctcatgcttgtaatctcagcactttaggaggctgaaaccggtagatcaggaggtcaggagtttgagaccagcctgggcaatatagtgaaaccctgtctctactaaaaatacaaaaaaaaaaattagccaggcctggtggcatgctcccgtaatcccagctactcaggagaccaaggcaggagaatcacttgaacccagaaggtggaggttgcagtgagccaagatcttgccactgcacttcagcctgggtgacagactctgtctcaaaaaaaaaaaaagcctactgatacctgcaacaacatgggtaagcctcaaaacttcatgttgaattaaaccagaggcacaagaatacatgccgtatgattccatctagaagaatttctagaccaggccagaatatggtgagaaatgagaataatgattgcctccatggggcgtgcaggtagactggtgaggcccaaggaaccttccaaggggaacgctgtccttttttttttttttttttttttgagtcttgctgtgttgcccacagtcaggctggagtgcagtggcacgatttcggctcactgcaacctctgcctcctgggttcaagtgattctccgattcaggaggtagctgggattacaggtgcctgccatcacgcctggctaattttttctatctttagtagagatggggtttcaccatgttggccaggctggtcttgaactcttgacttcaggtgatctgcccttggcctcccgaagtgctgggattacaggcgtgagccaccgcgcctggccatgttctctatcttgaaaggggtttgggtcacattagtgagtgtacttctcagactcaccaaagagtacacttgacacctctgcatttcattgtttgtgaattttaccctgaaagaaaaaaaaccaaatactgacatgaatgtgaaagactgaggagaaagtgaacagatgtctgcaacttactctgaaattcaacaaaaagggaaaatggacagagacgtaataaagcagatgaagccaactgcttttgagatggaatctcaaaatctctgtcacccaggctagagtgcagtgtgcgatctcggctcactgcaatctccaccttccaggttgaagcgattctcctgcctcagcctccccagtggctgggattacaggcgagtactgccacacccagctaatttttgtatttttagtagagacggggtttcgccaggttggccacgctggtctcaaattcctgacctcaggtgatccacctgccttggcctttgaaaagtgcttgggttacaggcgtgagcctctggacctggcagagccaactgttaatggcagaatgtaactgggtgtaagagggaccactaccattatttcaagtgtgtttgaacgctttcataatgaaatgcccagaaaaattatacagcatattggaaggcctccctgaggagacacttgaaccaaaactcgaggtgagggtgtgagggacacagagatcccggggaaggatgttccaggcaaaggccctggggcatgagcctgacagggattcctagagtagccaggaggccagaggagtagcggggaggcagatcccacggcctcctgggccaccatccatcagcccttggctcttactctaagaggggtatgtggggacaggacagctgtggtcactgtcctgagagcggactgaaggaggcaaggccagggcaggaaaaccagcaaggagacaatagcagcagttctgcaagatgtggtcggggctctggccctggtggcagtggcggccgtggtgtgccatggtcagattctggagaatcttgaaggtggaacagacaggatttgaggatggactgggtgtggagcaggagtggtggaagggggtggtaaaggaaaggaaggagtcaagaatgactctgaggaggccgggcacaatggctcacacctataatcccagcactttggaagcccaaggcaggtggatcgcctgaggccaggagttcgagaccagcctggccaacatggtgaaaccccgtctctaccaaaaatacaaaaattagctgggcatggtgacgggtgcctgtaatcccagccactcgggaggctgaggcaggagaatcgcttgaaggtgggtggcggaggttgcggtacgccaatattgtgccgttgcactccctacctaggtgacgagcgaaattgcatctcaaaaatgaaaaataaataaatgaaaaaggtttttggcctgaaaaggggagacaaaagattccaactggagcacattttaggggaagatcatgggtttgttgtgcacaggtcaagtttgagatgtctgtcagacattcaagcagacacatgaagtagaggtcaggccactggattcaggggtgatggggcaggggagggactgaagggcgagtcagccctgctgactgtcaggcaggggcagagctcacagcttgggacttggggccctcctcctccacgttggcctcagttcagggctgagtctgacaaaagacaggtgtaatcactttccaaggctgacccagttctttggctgctctcagtgggcctggtcacatttaatcttctgtggcactgtgtgtgtgaggtttgtccagtttgacacacagctctggatcaaaagtcggcaaactaaggccctcagttaagtctgtttgttttggcaaataaagttttatccagatccagccaatctcatttaggctgtctaaggccactacagcagaaccaggtggctgccagagaccacatggcctgcaaagcctaaaatatttactgtctggccctttaagggaaacatttgccgactcctctccatctttcattaaacagggtgtggttctgttataggaacacacagcaagctattgaataagacatttaggtggttcccaactttttgctattatgaaaatgttacaataaacattcttacccttgtttccctgggctcctgggcacacacagtggaattcctggtgtgtaggaaagacatgggcatcttcagtttgggtcaattttgccaaattgctctccagtgtagctgaggtcagttacactcccagcagcagtggaaagagcccatctttccacgttcctctaaacttattacctatcaggtgtcctcagccttcagtagttaccagtctttcactgtgtgtagattctcttggatttcctggctgtgagtgacaggtttgctctttttttgtcttggtgctctggacccctgtacaatactgaattgtctttactagccatttgttcctggcttttaagagaatatttcatgttttaccacatagtatagtgttttacctttaagtacatgtttactatacgttgggtttttttttttttttttttttttttttttttttttttttagacaaactctcgctctgtcaccaggctggagtgcggtggcgcgatctcggttcactgcaacctccgcctcccaggttcaagtgattctcctgcctcagcctcccaagtagctgggactacaggcatgcaccaccacgcccagctaatttttgtatttttagtagagacggggtttcaccatgttggccaggatggtctcaatctcttaacctcatgatccgcctgccttggccgcccaaagtgctgggattacaggcatgagacaccgcgcccggcctgtttttgttttttgagatggggtctctcgctctgtcgccaggctggagtgtagtgacacaatcttggctcactacaacctccacctccctggttcaagcaattctcatgcctcagcctcccacgtagctggactacagacacgtgccaccatacccagctaatttttttgtattttgtaatttttgtattttgtattttttgtattttttttttttgtagagatggggtttcaccatattgcccaggctggtctacaactcctggactcaagtgatctgcctgccttggcctccccaagtgctgtgattacaggtgtgggccaccacacctggcctattttttgttgttgttgttttttgtttgttttcagcattttttgttgtttttctgagaaagggcctctgtcactcaaacgatccttcctgagtagttgggactataggtgtgtgccaccaaagccagcgaattttcttatttttttttttttttgagacagagtctcactcttgtcacgcaggctggagtgcagtggcatgatcttggctcactgaaacctctgcctcccggattcaagcaattcttgtgcctcagcctcccaagtagctgagattacagaatgcaccaccacacccagctaacttctgtatttttagtagagacagggttttgccatgttggccaggctggtctcgaactcctggcctcaagtgatctgcccacctcagcctcccaaagtgttgggattacaggcgtgagccactgtgcctggcctaattttctcatttttgtagagacggggtctcactatgtggcccaggctggtctcaaacttctgggctcaaatgattttccaacctgggcctcccaaagtgctaggattacactattactccttcttaaatttctttgaaactctgctcatggattttctgtatttattatctaagtaatacatctatgtaataaggctataaatctgattttttttttttttaaagaaatggatcttattttgtcaccgaggctggaatgcagagctgcaatcacagctcactgcagccttgaactcttgggctcaagcaattctccagtctgggccccccaaagtgctgggattacaggtatgaaccaccacacctggcctgccatggcccccctcccaagttttctttcttttttttttttttttgatggagtctcgctctgtcgcccaggctggagtgcagtggcgcgatctccatttactgcaagctccgcctcccaggttcgagccattctcctgcctcagcctcccgagtagctggaactacaggcgcccgccaccacgcccagctaattttttgtatttttagtagagacggggtttcaccatgttagccaggatggtctcgatctcctgacctcgtgatccgcctgccttggcctcccaaagtgctgggattacaggcgtgagccactgcgcccggccaccaagttttcttagcatatgtatcctcattttttgtttgaactaaataatttttatttatatatgacttcatatttagaataggtttaaatttccacacagctggagcttacgcggcttttgtctgtggccaaagaatatggttgaaactgatttgatatctgttgagatttgtcgtgcaccctagtagttgggtcatttttgtaaatgttccttgtgtgattgaaaataatgtgttggtctcacacaggtctgaaatttaaattttaaaagttaaaaaactaactgtcaggttttctattggggttcattgatcttgattagtaactgtattaacatcctctatgtccttttttttttggttgtttggtttattagttactcaaagaggtcttatgtctccctatgatggaggacctggcaatttctccttgtgttcttaatatattttcagcctcttttttttttttttcgagacagagtctcactctgttgcccaggctggagggcagtggcgcaatctcagctcactgcaacctccgcctagcaggttcaagcaattcttgtgcctcagccacctgagtagttgggatgacaggcgtgcaccaccacgcccagctagctaatctttgtatttttagtagagacagagttttgccatgttggccaggctggtcttgaattcccagcctctagtgatccacccacctcggcctcccaaagtgctgggattactggcatgagccactgcgcctggcctattttcagccttaaaaacaaaaaccctggaacatagaagttcagaactttcctctcttcacagagttcctcctcgcatcatttcatgttgatcctcttatccccagtgtcttctgcctgaaggcctattttgtctgagttttctataggtacatcttttggttagtttttctctagtacaccttttcccatcgttttactttttggtgcccttaggttttaaatttcctcttgtaaatagcatagagctgcatcttattttttcttggccaatctggtcatctgtgttttaagaggtgaatgtaaaccacattttctacctctggttttgtactatatatttaccatcccttttactttgcttcctttttctccctttctgccttccattatagttttaatacccatcactacccttttctctgcattggcagttatagttccgtttgtattcttttggtgatcctcttaaatatctgaaatacacacctgactttacaaagccagacaatgctcagtctctttaaccccctctcaaattgccctctcagtcttccatgttcttgtgtctcatgcatcttgtttctgtggcccacaaattaatcattattattcatattgcatattaaatgcttgtttagattcacatgtttaccaatttgctcaccatttttccatctaatttcttccttttgggttccatgtccttgttactaaactacattctttaaaaattatttcggcggccaggcgtggtggctcacacctgtaatcccagcactttgggaggccgaggcgagtggatcacgaggtcaggagatcgagaccatcctggccaacatggtgaaactccatctctactaaaaatacaataattagctgggggtggtggcaggcgcctgtaatcccagctactgaggaggctgactgaggcaggagaatcgcttgaacccgggaggcagaggttgcagtgagctgagatcgcaccactgcaccccagcctggcgacagaacgagacttcgtccccctcccccctcccccaaaaaaatgttgatcttcagtctgcgcattctgctctggattttaagcatcatttctggcagctctttttcaggaactgtctctgcaggtctttcagtgttcgcctctggagctctgctcgggcccgcgagttctcctggcgttgccatctgtgcccttttccttattccccatcacctgtctctctggtgagctgcttccgatcagcctccaggtccacgatttctcttctgttgtccttttctgccttctcacctcatcctctgagacctgaatttcgatggctctacttttcaattatattattctttttcaaacctgggcgttcatttctagcatcctgttctatcctgtgtctgactgtgcctcccgcaccttctcccttctctcgccctaagccccgtgaaggcgccgggcctttggctccggctgtttcccacggcgcccagaaccgcgtcagtcctgacacagactcggtgagggcgggaagtggtgccgtggggctgcagcctggcccgcccgctccatcggcctagggcggccccaccgccctccgggccttaccttgagttcgggctgcgggagaagctcccgcgctgcccatgacgtcacgggactgtgacgcgcccagaagccccgcccctcgcgtcccggtccgcggacccaggctctctgcgccgtgacgtcacgggtccgggcgggcgggttgtgcgtcggcccaatgggagcggcgcactggcctcccctttaaggaatgttgtgacctgacgtcaccgggcgagttacctcccgcagccgcagccgccgtgctcagcgcgagccccggagcccttgagcgcgaggcgcggagcccccggagcccccaaaccgcagacacatccccgcgccccagagccccggcctgcgcgcccagccgggcccgcgcgatgccctcagaccggcctttcaagcagcggcggagcttcggtgaggcccggcaggcgagctgcgagctctggggcaggggtgccggccgaccccgactgccgcaggtgacgtcagccccgtgacgtcaggctctggctggaccctcgggctgggaccagctccggcctgggcgggggctgcccgcttccccaccgcgataggtgccaggggctgtggggcctgatggccccgggggtgggggctggagctggggcgtggccgggggccgcccctccgggacaggcggggcggacctgggccggcccgacccggcctcacggtctggccgctgtccgcagccgaccgctgtaaggaggtacagcagatccgcgaccagcaccccagcaaaatcccggtgagtcccgcacccccagccctgccccgcccccgcctcgcgcgttcccgacacgaccccctgcccgcccgccctgctcccaggtgatcatcgagcgctacaagggtgagaagcagctgcccgtcctggacaagaccaagtttttggtcccggaccatgtcaacatgagcgagttggtcaagatcatccggtgcgtgggcagccgccgccaggaggtggctagggtcgggaggggagccgggttcccgccgagaaggggtgggagtggggtcaggggtgatgggaccgggcggtgggcccctgttctggggtggctggaaaggtcaaggtcggggctgcagtcggtgttgggtcagaggtgacagctggggtgagaatgggtgtgaaaggctgggaatcattctgggggtcagggctatgtccgtcccgcagccaagcccctcacagctgcatactctcccgccggctgcaggcgccgcctgcagctgaaccccacgcaggccttcttcctgctggtgaaccagcacagcatggtgagtgtgtccacgcccatcgcggacatctacgagcaggagaaagacgaggacggcttcctctatatggtctacgcctcccaggaaaccttcggcttctgagccagcagtaggggggctcggcctgggagtcgggcggccccggtcaggccctgcccagagagctcctggttcctgaactgagctgcctctaccgtggtgggctgggcaggcatgtgcccccctagtcagagggcaccaacccacctactctgcccctgggtggatcctgggccggtcgtgttagggttgtccctctgggtgctggctggtgggatgggggagggtggggagcagctcccagcacccctgctgtgtggttcatcttttttttaggcccctgcctgtctgcccatctgcccctcacccacccgaggctctgcccaccgcctggacctgcccacccctgaaagactggcccctggctccccgcccctcggtctccacgtggtgtatggatctgtggtcattgtccctctgcagaataaagattgctcaggcctgcctggccctgtgcctccagccgcttgcttgggagtggggagggtgctggtggggctgcccgcaccatccccgggctctggcgcacagacttgtgttctgtggccgcggtgctcgctctggaaacccacacctgtgtgtagtgttccagaacattattaggggccaccccctctaggagtgcaatgcagatgtggtctcagggtagacttcataacaaaaaacatttattaagtagccacaatctaacaagccctgctcacctgcctcttctccttcctgtctgggagggggctccttggtgtgcagagccacaaggtgggggtccaagttggggagctcccagttcttccccataggccttgctgtcagtcagccatgggtcccttttggtaccagagacttgtgaccctggactcgaacctcttctgcccaagcactcgcctgctggcaactctggctggagggcttggcccagcttctggccccacagccccctgaggtccatgcagccctgtgccagccaggcctacttgagcacgagcatggcctctgtgccatccttggcggtcaagtagaggccatgtgtgaggtagtactcccgccgcaggaaggcatagaagtaatcagagatgagcaggatctggggggagagagagggtgtgaggcgctgctgggtacctccccctaaacccaggatccctgaactgctggcaggtgttgttggaagacaggaacgcccctgcctggctctggatcacaatcactggagaggccctcctcagggcccccacctcagggcccataattgaccctgcaaggtctggcctctcagaagctgcctggactccccctgcccccacccatggtctacacctccatcccaggctctggcctcgaatgccagcctggtgcctgtgcaaccagaggcctctgccccatcctcccacagccacttccatcccagccaggtccacatcaaactcctcaccttccctctgtcaaatacacttctcccactcagcatccatgcccccatcttccagccaggtgcccaggccacaaaattgccctgacacttctctcatacatcgagccaccatgacctgtcaattccccctaaactcaaatccaccctttggatccatccccacagtcactactctggacagagccactgtcatctcatctcctaaacaacagcaaagcttggtccttgggctccctgctctcaaacccgtgcccaccccattctccctggcagccagagggagcttttcaaaacccacatctgatggtgttacttccagccttcaaatcctccaaaggcttcccaagccttagggcaaagctcgaactccctcgtgctctgagaccttgctagggtccctgtccgccctctcccggctccacctcaccccacggcaggatctttactgtttcttctgcctggaatgttctctccccgttcatctagttgacagctgcttactcttcagggctcaggaaggatcacttgccccccagattagttcttggccccactaatctctactcgataacagactcatcgaaagtgtaattttccattcagctgacagcctgactgtgcctcctcccctggcccggggcctccatcagggcagggtcttcgaatggttctgtcactatggtatttctgtgcccagctcagtctgtctgtcccattctgggccacacacagaagaatcaaagggagcctagaagctcagcccactgtctcttcaaggaggcccagaaaggaatagggatttgccaagggccctatacaccagacccggagtctgcaatcccagtcagcccaagcttcccaagaccactggtccctggagcaggttgggcagggcccagcctcagagaaggatgaggggacaggggctcacactacagacaccgcagctctcaggcacctggaggcctcagaggattggcaccaaccacctggcacagatggggagactgaggcacagagcacttggctatggtcttggggcaagacaggttgagctaagcctgggatctagacctccagaccctgtcctgggcagcttctcactgacctgaaggtaacacaacagcagctaaggagagatcagaggcgcctggaggagttcaggaaggtgtcctgtcaccagcagctctgatggcctcaggacaagtacctgccattctatcaccacagaagcccatctggaaggttgaacaatcctcatcttaaacagatggggaaactgagactcaaagggttcaatggttggcctaaggctacacctggagcactggactaatggccatggacccagaaaggtggtctgcctggggcccagatcactgatgagcacgagattggtcacagcgtcagcaaagcagacagagctcaggcagcccccgaggccctgcccccagctgcccagctggcagctccaggctggcccactggggggcagtgatcacagcaaaggctgacctcataccctgcagccctttctcacccaggcccgagatgccatctgggcaggaggagcccaaagcaggggctgagctcagaggctgatccctgaaccaggtcagctgaggggcaggtgcagtcacaatccacaacaatcaaaacgaagcaactccatgtcacacaataatcatctggacaagaagcaggaagaaaaagattaggttattaggttggaccatatgaaattgccagttttgcagataaaaaaatggttgaatactggcaatttcatatgatccaacctaatataaaacggaaaaacgtacacatggaaaagtaagcatgttatttagaagtaccaacagaaataacagtaagactttaggtagctattcttttcccctataagccttaactttgcaaactacatacatgtattccattgataaaaataaaacttcggcgaggtgcggtggctcatgcctgtaatcccagcactttgggaggccgaagcaggcggatcacctgaggttgggagttcgagaccagcctgaccaacatggagaaaccccgtctctactaaaaatacaaaattagccgggcatggtggcgcatgcctgtaatcccagctacttgggaggctgaaggcaggagaatggtttgaacctgggaggcggagatgcgccattgcactccagcctaggcaacaagagcgaaactgcgtctcaaaaagtaataataaaaaataaagcttcaattaaaacaaatcagccaataaatcaatgaatcaatacatcaatggggggggggagataaatcttccttccagaagaattccaaacaatgtaggtagttatatccccctcccatagaaggagcttaattcttgtccactctgcatctcctaagcctaggggggtctagacttggttactcacttcctcctgaggagcagggaaagggaaaagagtaactttacagtggagagacctggccaacactatcttaaccacgtggtggaggttaacatcagcttgaaatcacgtggctagcatgtaaccccaatagatgtgatgagaagggcactttgcctggggtattctttctaaaaacccacaaccccaggatagtcctaagaaaagcatcagacaaacctaaactgggggacaaacctaaattgggtgacattctacaagatacctggccagcgctcctcaactgtcaaggtcatgagaagtcagaaaagactaagaagaaaagcagaagacactggggagatgtgaccttacatgtaatgtggacctctcgatggggtcctggtagagaaagaggctgtgactggaacaacaggaaatccaaatccattctagtgtttcagactaatagtaacgtatcagggtgagtgtcttagttttgacaaacacatcacggtaaaatataagatgttaacaacttaggcaactaggtgggggcttacaggaactctgttctatctctgcaacttttctataaatctaaagtgattctaaaataaaaagtttatttaaaaaataaatgaactagctgggaatggtggcttgtgcctgtaattccagctactcgggaagccgaggcaaggggatcccttaagcccaggaggtcgacctgggcaacagagcaaaactccagctcttgaaacaggaaaaaaattaacagcaatgacctattgttgtatgtaacaaactcaaaatattttgctgagtgaaagagagctttggcaaatgtacacaaaagatttgcacttttccctgtataataaattttacataagaaaatgatacacatgctgaaatatttagcaggaaatgtactgatgtctgcatttcaatttgaaatacactaaaaaagtaagatggactgagggatgatggaagaagtacctgaagatgtgaatggtggactcccgctggtgggtatgtatatgggtgtccaatgctaaagctgtcaactctgctgtgtgtgtggaaatctggaggataaagggggtggcgggaagagccctgtgagcggcttgggcacacagccctgggtgtcatcagtcctgagtgagcaccctgcccccagggagaggacaccaggctggccgagaggcctggccctttcagagggaagcctgtagccaggacaacctcttctgaccttggggctttccatttgggccgtgaggagagcagggatttcccagaggccctagggtgcagccaacacagcagctgcagacccagagcccctttgcccagtctggacaggggcgagttgggcaaggggctgtggaatttgcatgggcgagtcagcggctgtgtgatattaagtctcttcctgtcccctgggctgcattttcctcatctggaaaatgacagtaataggctctagcttgttaccaacaatgctgggctcctctagtttttttttgagacgaagtctcgctctgtcacccaggctggagtgcaatggtgtgatctcagctcactgcaacctccgcggttcaagtgattctcccgcctcagcctcccgagaaagctgggactacaagcgtgcgccaccacccctggctagttttttctttttttgtatttttagtagagacggggtttcaccatgatagccaggatggtctcgatctccagacctcatgatccgcccacctcagcctcccagtgctggtattacaggcatgagccaccgcgcccggccgggctcctctagtctttgtgccagttaggaccccagaacatgtcactctgtgtcctcaggtctctggatcccacccaatgtggctgaaatactgccttgccaatccccttctcagacttgccctcttctcttcctgcagccacctctctggacacacacacacacacacacacacacaggtgcacacacacgcacactcacactgctcacacatgcacacacaggtgcacacacatacatgcacgcttgcactgctcacacaggctcgcactgcactcacacacaggtgcacacacacaggtgcacacatacacgcatgcttgcaatgcttagacacacatgcttgcacacacacatgctcgcactgctcagacacgctcacattgcactcacaggtacacatacacgcacacaggtgcacacatacatgcaagcttgcaatgcttagacacacatgctcacacacacagatgcacacacatacacgcacgctctcactgctcacatgctcgcactgcactcacacacacacagatacacacacatacacgcacgcttgcctgctcagaagttccctggctccccctgccctgcccagcagcgctgcagctcccacctatccctcagaggctcatctcctgccaggagtcttctctaaccctgcattgttacatggaccctgaagtgaagtcactgcccactggcctcccaaccaaatggggctgcatttgctccagttctatggccccaggcccggcacagggccagctctctctgagttgtttgctggtctgtaccctctcagcgctgcccccagggacggctcggtccacattcctctctatggcagccatgagggctccagggccgcctccctctgggaccatgatgaagagctcatggggcagctagctgataaaggggtgaccagggacagacaggatgaatcagaagtagaacgaaaccctcagaacatgctctagtgcagggcaggatggagagacagggaaatgaatatcttctgagtgtctgccctggtccaggccctttaacaaaaaaacaatattgtccctttccaaccccccagggtagggctgacaatgcctacttagagaagggaagctcaggggttatgggccctgcaaaaggtcacatggtaggaagtgaagagttaggggccagtcctgcctgtcagaggcccaatcctgagttcttccacaaccccctagggtctgcacccacatgaactgagtcctgctacatgccaggcctgtgctgacacctcaggtacctttacaccctgcggagtctgctctccccagttcacagctctgtcactcagtggagagagagagagattgactttttttgtaaaaagccagtagaggttgttaatacagtgtgtcttgaaactactgggctcaggacagcagccttgtccaccaccagggctgcagattcctagagaagcaggtgctatcacccaggcatgtcctggttccccaggcctcctgctgctgttggggacacagacactgacatttgacagtcagcccacgctggggggaatgcatgtggccgtcacagttggcaaagtgcagcagcctctgcccacctgcctgggatccaggaagctgggaggcagaggaggctggcggccgactgtggagctggacagcactttggcgtaacctggcaacccacaggccggagcggacattatgtaggaggaaatggtggaggagaaaactccaccctccagctctgaagatgcaaagtaacaagtgaaatctctggacctcagtgtcagggtctgagaggtcacaaggtgagactgaggatgaggctacaagtaactgtcccttacatggcacttttcacttacatggcacttttcccacattcagtcctcaaaaccaccttcccagtttgaggaaactgaggccaccaccacctcccccagatttcaacctcccctagcctcgtccctggtgccctggatgccaggctcacacctcttacctctgctcttcccagcagtgaggttttcagagcatggatctgatcacatttatcctcagctcttaaagccaaaggtgcagtctggacctctgcataagaggcccttgaaggcctgtggtctgaccactgctgtctgaattgccctcattccctctcaagtggtacagccagtcccactgagctcccagcagcacggtgttcctcctttgctccctccttcctcctctctctctctctctctctctctctccctccttcacccccacccaggtcttgctacctaaaatcatagaacccagttagatcctacccatccctcaggaccccacttagaggccaccttccccaggaagcctccttaacagcccagctctgggctcccagctcgtcaggctgccctgtcctgcccatgtcttttcctttctctccacagaccgagggctccttggaagtacacctctgtctcattcacccctcgcagagtgcctggtgaatagtaggaacctaattaacatttgcaaataaataaattagcttcccaggagttacgggatgtgcctgaggccagcgagccaggacagacagggctggagtcgctatagagtttgggcttccagagccctggccttctgtggcctttgtcctgctgtatgtagcctgggctcttcctgtcactctggttgttggggaggagaataggctgggaagggcctgtgagggacaagcttgggatgctcagtgctggaaggacaaaggaatgaactaagaccttgacagaattacactagttgggaaaagcaaagtaaacacgcacatccagcaggatgaggacaagggctccaggttggccacaggcaccgcatatcgggagcaacgagccttcccacacacagacctgggatcttgcacagcccaggccacacacaaccggcaggaagaaacctgaaatgggtctcgagccaaccccaaatgggggctacacaccactcagccactaatgacccacccaacacgtctccaagcatttcctcataggtcccatttcccagaatgacacaccaggccaactgagaggcaactccgggagacaggattgtggtttcacctgtgttgcagtgaacagtgagtcccaggcaggggacaggcagcatgcaggaggttggtgtcagacctcgggcttcaggcctcactcaaaacagaaaggagaatggccaatgcaaggccagcccagtatctgagggtctgcagtacagggaggggtcagggctggcccctcatggcaaataggcagtggcttgaggagtagggttccagatgatccagatcctgcttggaagggtgggtggttggccaggtgcggcagctgacacctgtaatcccagcactttgggaggctgaggcaggagtttggcttgagctcaggagttcgagctcgtaacaacatagcaagaccctgtctctaccaaaaatttaaaaagtagccaggtgtgggggtgtgcctgtagttctagctacttgggaggctgaggtgggaggacctcttgagcctaagaggttgaggctgcagtgagctgtgactgtgccactgcaccccagcctgggcaacagagcaagaccctgtctcaaaaagaaaaaaaaatgaaataaaattaaaaaaaatttttttgagatagcattttcactcctgtcacccaggatggagtgtagtggcgtgatctcggctcactgcaaccttcgcctaccgggcttaagcgattctcctgcctcagcctcctgagtagctgggattacaggtagcttgccactgcacccggttagttttgtatttttttgtagagatggggttttgccatgttgcccaggctgttctcgaactcctaagctcaagcgatctgcccgcctcagcctcccaaagtgttgggattacaggcacgagctactgcaaccggcctactaaaataaaatttaaaaaaggaagggcaggcagacgagaagtctgctttagatgtagacacagggcaggagtggggctctcaggccagctactgggatacaagggtaagggggctctggctctgaccccctagtaatccagtagactagccagaggcccaaatcagaccaaaacagggattggcacggggaggtcagggtgtacagaaatgtgttagagcattggtcataaaatgtggtttctgatgccagctcattcaatttgtcatcaataagtagtcactgaatattcttcttggtgctggggatacagccatgaagaagacagacccagggctcgccctaatggaacccacagtctactaagaggatgtgacaaacaagactgtggataaatacaccccttcacagcttagtgagtttgggtaagtctctaacccttccaagcctcagtttcctcatttgtatcatgagttaataatagtacttccttcaaagggctgttatgaggagtaaattccttataactaaagaaaaaaaggaaaacaatgtaaagggctgtcagtagagtagttacataaagtgtggtgagttcacatatgcaggactcaaataaaaaggaggttcctctctcacatatgagcaaggaaagttcacccagacattttactaaaagggaaaaaagtcctactttcatcattatgtcaataataaaacacacatacccacatacaaataagcctctctctccatgagcctatgagtttatgtaaatgcacacagaatggttcggaaggccatctgagcacgtgatcagaagattatagggatcacgtggggccagcccctagtaagctctcctgaaacatgagccactgttatttatttttatttttttttgagacacagtctcgctctgtcgcccaggctggagtgcagtggcacgatcttggctcactgcagcctccaccttcagggttcgagcaattcttctacctcagcctcccgaatagctgggactacaggcgcgtgccaccacatccagataatttttgtatttttagtagagacggggtttcaccgtgttagccaggatggtcttgatctcctgacctcatgatcccaaagtgctggaattacaggtgtgagccaccgcgcccggccgcataagccactattaattttaattttaggagaagattttcttatgttctctgtttttaaacagaatgaaggtgagtgtgacactttgccctactcttttaaaaaagctaaatttaaacaagttcctttttgtttatatgtaatccttgattaatattttccacctgctggtcactgactcacaaaataaaagggttaaaaaaaaactgcttcctttggttcatggactgtctctccaggaatctgctctgggtatttgaagagcatgttgctcttgctgtttcccatgtcaacacacatgagtaatggcaacaggacccacaagttatgtccaatcctctcaacaccctggaagctgtgggtcatcatcccggtttttgagataaggaaactgcaacctagagaagttaaatcacttgaggaagtgggggaggccctcaagaaatccactggtctcaatccctccttcgttctctcacactcaggcgcaccccccaccatggatggtttactgttgtcatttcctgttactgactctgaggaacaaccataattagcaaatgaaccatgccacaggcagaaaaataatagctcccagggtaaaggatggggccttagtcactggtttacctgccggtataactaataatccacacataatttgttctgtaatagggtatggcactgaacaactcaaacagagcaggatttaaaaaaaaatctataagccaagatgttctctatattcagctcttgatttcagcaatgatatcaaggttctagatacttccttgaaatctgtactcatctggttcctaagagagctctgctttgtcttgcccaaggaggagaaaatgaggcaggtgaataccaggcaccttcctagctcacagcaggatatggaactgagaacatgtccccaaatcccgtacgtctcgatggaagacacagaagcaggggctgggtttgggctgcgcaggacatgcaaggctgagaaaaagacagtgggacaaggggacctcatgaaaggtctctatgaggaggtgacacttcactcttagtaaaacttgaaatgtctcattttgcactctgaggctcccaacaggtccaaaggcaagggtggcataactttcatgaagaggggctctcttacctcagtcagcgctctgggacaaggacatgcctcgagtgactgcctcagtgagcaagtggccccatctgatgcaccctgttagtgacctggcagcagcagcaacaaagtcgaaagccagcagccccaggaagtacttggaccccctgctgggaggcctgtaggttggtgtggcctgcctgaagggcagcttggaaatacctgccaaaggcgtaaaatgcatatgccccctgacccagcaaatcccaccacgtggaatctactctataaaactccagcatgtgtgtacaagaatatgtggagggatatgcaaggctcttccattttatttatttactatttattattacttttttatttactaattattatttttattatttattgctattgaccagcctggtctcaaactcctgacctcaagtgatcctcccatctcagcctcccaaagtgctgggattacaggcatgagccaccaggcccggctgcaaggctcttacatttaaagtgacaaaataggctgggcgcagtggctcacacctgtaatcgcagcactttgggaggtcgaggcgggcaaatcacttgaggtcaggagttcaagaccagcctagctaatgtggtgaaaccctgtctctactctctaccaaaaatacaaaaattaggcgggcatggtagtgcacgcctataatcctggctactcaggaggctgaggtgagagaattgcttgaacccaggaggtggaggttgcagtgagccaagatcacgccattgcgctctatcctgggtgacagagtgagactctatctcaaaaaataaatatataaataaagtgccaaaataaccaagggcaacctcaatgcccatcagcagggctgtacctagtccaaaccactggatgttacagaggtattaaaaaattatctcaagacaaaatcattaagtgaaaaacagcaagccaaagaatgctacttaaaggagaatgccatttacctacataaacaaacaaacaaaaaaccctctttatgtacctgtgtctatagctgtctataaatgcacagaagaaagtctgcaaagacacataccaaactgatcccaaaggccacgtctgcagaggagtagaaaatgatgggggctcaggcagatcttttcttttcattgcatagtctttttattttttattttttggtagagatgggcttttgctatgttgcccaggctgttcttgaactcctagcctcaagtaatccttctaccttggtctctcaaagagctgggatcacatgcatgagccaccacactcagcccattccatattcttctattttgtttgacttctttcccccagcaataatgaattcatgtattacttgatgatttaaaatacattttaaaaagagattaagaaaaaaaaaggtaagagatcatgccaagagtccagctggtttctctcagctatgaacacacttgatccacctgcctttggtttccatccctaaccccaatccctctttccaataattcagtttctcctgccttcaatggcacctgaccacttgcagacaaccccctgtgctgctttagagtcccttctctcagaaaggcagccacagagaagaaagctgttatctggcaagttccatggatgcttcataatcactgcaactgtatttccagacccaaacttaagactaagactcatgacaagacaacaggctgtggactatttctgtggagcttgccaacctccctagaggcccagggcaggcccaatgcccacccatgccagctaccactggaaggtaaggaaaaggaaggagatcccagaaaggcaggagagccagggcaaccttctggattccttcaggatatgcaattgagccctgcagaattctgcctgcgtgggtcagaagtaagagaggctgcgcatccaccaaccctaactacagtgtgagagacagaacaggccctccggctgggccccacccaggctacaaggccctctatctctctttcttctgctcacaaaccaagacaactggctgggctgaacattaatcctccagaaatgtccatgcaggaaacaccagtcccatcactcactgaaaaagccctaactcctttcttttcccgcagctaaccttggaggcaagaattaccctggggattattcactggcatcattagtctttccagccagcctgcttcccatccaggctattacacataggaaatgcctggctgtgccaatggcaattgaaatggtaaatggtacaagtgattctcaaaagacttccactacgaggccagagcctgacctgagagaaggcagcacgtggaggagggaacttccaagaagcgtgggtgagtccacctagagtttgctagacccactgccacagaacctctggaagagcttattaaaaatataaattcctgaccctgtattccacattgaatcaacatttctgggagtgggatcagagaacctggctttttaaaacagagccatgtacttgggacggctgcaacataattgcagagtttaaagcctgttaacagggaatctgcatttttaacaagctccctctgaggattttgattgagaatcctgctctgtggaacagagggacaggcttcccagctcaggggaaggctgagctccttgctggtactcctcagcctgtgaccacagcctcctctccaccgctcccagccacacaatttatgctcaactccccaacagccagaccggcccccttctcctctgcctgcctttgttcctgctgtcccgagagtccgcagagcctctcctccccttgccttgccctctccccctcactctatctactccctatgggtgctggaaccacaggcaccattacagaaaggggtgcctcagaaatcaagccttatgtgaattttgttcttggctcctccaatgaccttcgagaagagaggacctctgcaagcctctgtccctcatttgtaaagtagggctaacatgccctgtctcctaggcttgctgagaatacagcatggctatggttcagtgtggtgcccaatacatatctgccaggttcagccttacactgctcttacttccccgtcctcactgactgggagctacttgaggggagtaactgtgcctccttcacgtctgcaccccccggtatgcagaatccaaggccatcgttgaatgcttgaggctgcaaaatgaattcctgtccccaagctgacccccatgctgtccctcttacctgcccaacgttgaaggtcagtgtgatggcataaaagaaattagagttggcacttcctgcataaatccagaggtgccacaggacagggaagagcagggaacagacgatgatgatgcaggtgaggacaaagatgtttctcaggactgcaaagacagagggttacagttagcctgacacgctctctctggcatgctttccctgctgcaatggcccccctgaatggagaggcccaaggtgagcatcatgtagctcaaaggcagagcacccccagaggtactggggtgccaagaagcaaaccccagactcctcagtcaatggctccccatgcccacagctggtggtagctcctggatttcgattatttcctcccactgtgggcttggctggctgaagaccagctatagttagaaatgccatgagtgcctcggggcaccaaacagggcatttcaggaagatattcccctcacctcctaatcttggagggtccaagagtatccctctccccaagcagggtgccatctggccatgtgggattatgggtgggaaccccagcatgaaccgtgacgattagagccccactgtgggtctccatggtgccacagtcctgggtcttaggaacacgttttccattctccttaactggtgtcttaggacccctgcctcgctcttcaaacattcccaactctcccttagatgataaaggacctctttttgacaccgtctctcactccttgcctctaagggaatgccgaatcccaccaggaagaaagctctccctgaggtctcaggaaggacctgctactcaagggtgatccagaggcagacaggctggctggcttcagccaaacaggagtgtagcatggcagccgggtacagaccttggttaaaatcctgctctgcatttattagcaagtttctctagacctcagcttcctcatctgtaaactgaggctacacacctagtatgtacttataaaaattaaaaattagggtgggcatggtggatcatgcctgtaatcccagcactttgggaggctgaggtaggaagattgcttgagcccaggagttcaagaccagcctgggcaacatagtgagagcccatctctaaaaaaattttaaaatttaaaaataaaaaatgtttaaaaataaaaataaaatggggctaaaatgcacacttcatttggtaaacaagatgacatgtgaaaaaatgacacagatatatcactggctacattagttttccattgctactatagcaaattcccacaaacttagtgatttaaataatattctttattattaaacagttctggaggtcagaagttccaaaatgggtctcacaggctaaaatctctagaggagaaccccttgcttgccttttccagcacccagaggccccctgcattccttggttcatgacccccttccagctgcaaatccagcaatggtggattgaggccttctcacattgcatcactcagaccttctcttctgcctccctcttccatcttttttttaaaatagactatttattttgagatggaatctcactacattgcccaagctggagtggagtggctggatcatatctcactgaagcctcgaattcctgggctccagggatcctcctgtctcagcctcctgagtagctggaactacaggcatgcacaaagaagcccagtggactttattttttagggaagttttagtttcacagcaaaattgggcagaagatttcccatattccccccacctccacctcttccactttgagggacacttgtgattacactggggccacctggattgtccaggataatctcccctcccaaggtcttaaagtccctttgccatgtaaggcgatgtcttcacaggttctggggattacaacgtggacatctttgtgaggggagggctactaccctgcctaccacactgtactttttcccccgttttaactctctaggggttatcacacaggaggattgtctgttacttttctttatctttatcatatttttaaaaactaataaatatcatttaaaataattaaaagaatacctttttaaaaagaacttagcactgtgcctggttcccagcagacacttaatgaatggaagttcccttctcttctctgatactgaccttcaggaaatcccttctcccaagtgacagttttgagagacttaaagggtggagaaactcccaaacatttaggccatttatattagttgtacaacttagtagagatgctatactgggggctcatgcattgcaaggggcctagatgatacagatgattctcaactcccgctacaaaacaaaatcacggccgggtatggtggctcacgcctgtaatcccagcactttgggaggctgaggcaggtagatcacctgaggtcaagagttcgaaaccagcctggccaacgtggcaaaaacccgtctctactaaaaatacaaaaattagccaggcatggtggcgggtgcctataatcccagctactcaggaggctgaggcacgagaattgctggaagtggagaggcagaggttgcagtgagccgagattgcaccactgcactccagcctgagcaacagagcaagactctgtctcaaaacaaacaaacaaacaaacaaacaaaacaaaatgaaatcacacggagagccctcagactagtcaaagtctctagggtggggttcaggcatccatatgaggttttaaaagcttcccaggtaattccaatatgcagtcgaggctgcgaaccactggattacagctgcagccccttacagtctgcaacagagatgccacccaactgtgtcaaaaggagaataatcaggacacggtagttcacagttctttgtaaagctgaatgttttcaagttacagttcattctttattgagaaatgataggtatcattttgttgttgtcattaaaaagtccttcattttataacatggggaagaatggctggtagttgattgttttaatgtcttcagcaaaataaaaagctggcaatctgtcacccgagtttattgaaacattagtggtctaagaaatcccacaatttggacactggcctggagggcttgcaagatcctcttttctaatctgaagtttctcaattctgggttttcaaagatgagaggccaaaaccctgactcaagcctcctgagacctcccaggaacaaggagtcttgcaaagggacgttttcactgagaattactattattattaaaccatgttactacctcaagaaggagaacaaatgcttcccactcctctaacccaacatcactatgtacatttctcagtggttctttctgatcccctggaaattattttgctgaaaagaatacagactattcccaaaataaaatgtttgcagcctgccagaccaggtggttcttgttctgtgcctccagccagggacacagatttcagacagggtgacaggaaggaaaccaagtgcaaagagacgagagaagctcactggcagcctctgggtgctatctcgaagggctgcaaagatacattcccatgcggctagagaaccatcaccagcatgcagttggcttctggcctgtggtgacctctgcaggaatggggagctgctattcactcttgctggctgacaggccagaagattaaagctatatatgccagagcagatggagctggagacctggggtacgggacagcttgttccaggcatcagaaagcgtcagaggtgaccagggcctaacaaggtgaaaggcttcacccttcatcagacttgcgaggccagatggaatcaggttccccaccacattcactgggtggcttatccaatctctggcaccatgattgatgaactggaacttcaggcaagccactttcccttcagagcctcaggcattcggaaagaaaatctcacctgaaaaatccagtccaatcagaaggggaacaggggggatttggggacttcaaaggccatggtgatattccctttcttaaacgaggtgccaaaacacgtgggaatatattttatcatgattctttatatgtatatctatcaacattcttttatcgctatacaatagtaataaaaacaaaacaaacacacacacaaatccagccctttggtaactggctccttctgctgtaccatgcaggctggcatgggttctgccagcaggctgttccctaacaccacaattgtgcgtctgtatgactcatccaagctccagagagtccagcgtctgggacctacactcagggaggggccacgttccttttctcctctccactgcacaggaaaacagaaaggtgaatgtgggagcatgcatgttagcgctgacagctaatgtttaaatggaattcctagccacattaaatatattcaacgtaggcttaaacacgtctcaacacatacatcccactcataggtcctaaggaccagggctgatgctgctcccagctaataatgattcacagttgtcaagccccaagcaggttctccaagcacgtgtactccctgctgcaggagcagtgaagcaaaggtggacagctactgttctctgcaggatcttcagacaacctgaacctgcagactatgtgccctgccagccagcaaaagcaactattagatcattcaggtttctggaaaccccatccttcttctttgtgcctcctcaccccagagggcataaaatagtttattcgtcttgaaaaatatgtttattctgatgactctggctaccaagcccgaagctctgatcacggaactatgtgagagactcccctgcataattattactcacgatactaactgcagtgctatttacagatattctttctcaaacttaacacactcatgagttattttctttatttgattaatggaaaaatcagatgctcagaaaggttaaatgatgtgcctaagaacacatggggctcgtaatggcaatgccaggaatcggagtcaagtgactctccagactgctcagcaaatgggatgaaagacagtcactgagagagaaagagtgcccagtgtgggatgggcaaccacaaaaatccattctacattcttgaaatccactatcacaaactgaggcatgtccatgttttggtggtctcatggtttgtcactggccactctgccgaggggccccaagctgactctcaacctgctggactgggtgactcttgtctgtgcagagaggatgtcaccacagaagacactgcttcctcctcccagtcaggccagatgggtcacagccccactaggccatcacctgcaggcgtagccctggctcagctgcccacaccactgtttaccttcactcagaggcacactcctataggtaggctgcttcccacagctagtcagtttcacttcctggttgacacccaaaacaacaacaaagattcacttcctctgaagcctgcactccctagttcattcttgacaccttgctggacacccacagcaggcaaggaaagttcaacagctcccttccatgcctcgtttagagaatcaggtggtgctgggccactgacactgcctctttattggggaggtttaaaaacccgctccacaaatgtttgcaaggtcttctatgtgtcagcttcagtcctgagtgctggggacacaaaggtgaatgagttgtgatatctaccctgacggagcccccaaacaatgaaaagaacccaccatagagggctaagagcactgggggcctaggcagcacagataggtcaccactaagccacctctgaagaggggatggttagagcttagaggggttgtcacagtgggcagggaagtctaactttgcccctctgccttctagtaacctttgggtgcagcgctggggaatggttcaaagcccagggcatagagttctgctgtctagtatggtagcctagctacatgtggcttctgaaatttaaattaaaaattcaggttctcaggcacacaagtggctagttaccctattgaactgtgcagacagaggactttttcatcatcataaagccctgctggacagcactgggtaggggttcacagatctggattccaatcccggctcttctaattagaagtcacgtgactttgaatgagtggctctacctttctgtacctcagttttctcatctgcaaaacgtggatacttacctcaaaggctggtgtgaagatcaaatgagctaattaatgcatgtaacactgtgagagccacagtggccaggtacacagtaagtgctcaataaatggcaattatttttatcatcacaagtccgcggcacctggaagcagatattgtgcttcatgcctctgctcccctcctagtgctgccagcataacaggtgcctggtaaatgcctatgaattccttttccctgcagcagtctcatccaggcccaggctgacacaaatctgtggcagaggcgggagtactcacatctgtagagatggttccacacggggaagaaggccatgtagagcgccacgtcccccactgtcgggtaggacttaaagatggcgatgacagcgatctggataaacatgaagaagatggggtgctccctggggcagggcaggggaaagagagagagagatgagtcagggaccaggcctaccctagagactcctgactccatcctttgaaccaaaaataatcctcaggggacttcaggaaggggctggctctgctatccacaaggcatgggccaggccccagtagcagagcagaaaactgcagggacccagaaatacccagaggtggtgaggagggcctggcaaacactagggaaacagcccacagagacatttcccatcaacagtccccctctgcctctgccagctctgggccttcccctaggagccacagaggaagaaaacaaatgaagtcagcattctttatgactgggcttaaatgactgcttggcaggataattaggcagcctcccttgccagaggcccctctgacaattggacgcaaggcaggaagtgcctccttgctgatgccttttttctctaacaacatggtcagcagggtctacagacccatagtgcgatgaacttctttccaggaagagaactgtgaactgcacagagcttttcagttcttaagggctgggactattcttgttaacttaaactaatagcagtttcaattattattttaacctaataataagtgatagcaatgggtatcctctcctgaactccctctgtgtaaagtccttttcctgcatcctctcacgtgatcctcaccacatctcaaccacccctcaaggcaggcaatcctgggccaggcgcagtggctcacatctgtaatcctagcacttcgggaggctgaggcaggaggatggcttgagcccaggagtttgagaccagcctaggcaacatagtgaaatctcatctctacaaaaaatttaaaaattagccgggtgtggtggcatatggctgtaatctcagctattcaggaggctgaggtgggagggttgctggtgccaggaggttgaggctgcagtgagccatgatcaaccactgcactccagcctggatgacacagtgtgagaccttgtctcaaaaagaaaaaaaaaaagtaggcaatcctctcacctgtacttcacagatgaggaaacagattcagagaagtgcactgactgagtaggttagtaagcgatggagttgtctccagagctcttaatcacgcccaataccattctcctgagtgctgatcacacttccaagctctggtcaggagagagttgggggacagagctcaatctcggtgcccctccgagagctgaccaagtgctaaagggaagccaacagggagaggctggatctataccctcctcagctacatttcaaccacatgcacatggcctacttctgcacagtacctagatgcctagcccatgaaggttttcttcagagattaatgacctttttgtcttgcaggtcaaaggtcagggtgactcaatgggtatgaatctgagatgtgcagacaaacatgtccacacccagaatgctccagtgctgctgtgcagcaagtgcctcagaaacgcagcttggcaaaggcgtgcagccctgtagcctctaagaagcgtccagctatagctcagtgtgaacatcttcctaaacacaatccacatcactggcttcaggcttttcaggtagctggtaacaacggcaacatttctatgaaaaggctggtgaaaatgcggtgacaaaaaaacagactacagcctcctgcagcactgcacagggactggggtggcctgaagggccctgttcctacaaagctggcactggaaacaaatcttgcagggggcaggagagcttaggtagagcttcatacccaggcagaagagaagacagcagggagagcaggtctcttcatattttctgtccccacaactgtgtgggcctggcttaggtcataaaatggtgacattattgcctagccaggagcaatgtgtggctttgcatgcagacaataaaagctgccggagagctggctgcacggccagtgcggaaaggtgccctgggatccctgctcctcttcaccccatggctgggcctaaccggaacaaggacagggaaggtggaccacagacagctggagagctcagctgggcaaggctgccagagttccggagcctgccaggccatggaaggagggtgttctgtcagaagccaggccaaggctgtgtcatgggaaggaagcatcagcttttgagattttacagaatgggaaccacgtgcattggtgcacagaccatggagaatggcaggaaggttaggacagagaacttgagctcttgaaacctaaatcaaactctttcaggttccccagaccatctaggcgtatctgtacctgtctgtgtctgttttcccttatctgaagctaggataatagaaccatttccggaggctactaaaagcaatctctccggagcttggcatggtgcagggggataagcatagattctggagccagacaaacctgagtctaaatcccagctccactgcttactagctgtgtgactgggaaaatcatcccacctctctgagcatcgatttcctcaactataaaatgggagtgataagaatctaacgcctacctccaggagttgctaggttaggtatgattatgtttcagagggtctagaaaggcacctggaatggagcaggcctaacatctatcagctctcttagactgcagaagaggactccacacatcctttggagggaaacagatcaggagattaaacagttgcaggtggccagcctcccaactaaaccatccagagtccctgtggaggacctgtcactgggctgttgatggagacattccaccagatacactttttccaaacacactcccctccacaactcctgttcttttttttttttttttttttttttgagacatgcacttccgcctgtcatccaggcagaagtgcagtggcacaagcagctcgctgaagcctcaaactcccgggctcaagtcatcctcctgcctcagcctcccaagcagctgggactacaggggcacaccaccacacctggctaatttttgttgttgttgttgttgtttttgttgagatggagtcttgctctgtcgcccaggctggagtgcagtggcacaatgttggctcactgtgacctctgcctcctgggttcaagcaattctcctgtctgagcttccagagtagctgggactataggcacccgccactatacctggcaaatttttgtatttttagtagagacagggtttcaccatattggtcaggctgatctccaactcctgacctcaggtgatccactcgccttggcctcccaaagtgctgggattatatgcgtgagccactgcacccaggcagccacctggctaatttttaaattttttgtagatacaggatcttgctatgttgtccaggctggtctcaaactcctggcctcaagtgaccctcctgcctcagcctcctgaagtactgggattacaggtgtgagccaccatgcctggccaccgcctggctctagtccaaaacagtgaatgggctcagcagcaatgtggacttgagcacctcagagtgaggccagggaaaatgctggggctccaaagcaccctcactgcagcctgcacccatgcgactctattgcctgctatggcgctggcaactgcggcaactgaaggcaggttccttaggtgagatgctctaaacctgacagcaggtgctccacatttgaaggccaccctcaaggctactagaggcaggggcttctcggacagctctgtacacacagcagcagcaggtccagccacttactttagctttatggctaaggggatggtgtagaagaagacgttgatctgaaacacacatacaaagaagaggctgaagtgctcaaacatctctgcaaagaagtaccagaaaagaccaatgtttggagtgagatctggaacagaaagtctggaattaagaaaacaaagggagagaaaaaagacaaaagttataaattgtctgctttgaccttgatttctcctgaagactttggtcactgctgggcagccaaggacgactttctccctagagagatcaggatgggaagggctctctaggtaccctggatacaggtaattaacaaaaatgagcagagacatataatgataacccataacaaatattagctaagccaaacaaatctgaaatgaggcagggattcatcctaggaataaagagactcacccctgttttactgcgcaagacagtttaaaatcaggagatacccagtactgtaacaaatgagttttaaaacacaggatctattttgggcattctaaagacctgcctagaggaccacgctcaaagatcctgctcctccccattcttactccacaccccacagcaggagtcagaaaaccgagtgcctgagaccgaagtgagacttctaggggctttaggaacaatcggtgggttctggctaagatccccagggtcccagtcttaattgagaaattagggtttaactggaaaactttttgtccaattaaatcagacaaatatttcgctgcaattctggctctcctaaagtttacatttttgatttaaaaaaatatgaagttgaaactgatctcaatacacaattcaaaaaggacaacaaatagggcacgcagagggagagatgagtgatggctcttggtcagatttccctgactgaggcctccgcccaggttaacttttgcctcttgctgtaactatacctccttttctgggaaatgaggtaaagaacacaatccgtggcccaggagaaagaactcttcacctggcaccgcaactcctatctaaggcagagcatgaagagctgaagttagcaagtcattgttatgctcagccaggatttaacacaaataagcagtccagaattccaaatgggagttctgccactcagatcccttccacacatgcacaggtttaagagtctgtcacctattgggctgtgagctccccaaagcttagggagcaaccgagtcttcggcacctatgcagagcctggcacgcagagggcattcggaaatgtttatagaattcatgaatataaactcagacaagcctgcaatactcaagtccatttgagttttccctcaaggtttgacgtgtggcaggtggcattattttcaaactgtcagaggccctcttgcactagaggaacacatccattcctgtttagaattgagcccaaacctcccagttagaggctggtatttgctttggatgttcccagggagtgctctttaacccacttatgctggaggttgcaaatttttttgtgtgaaaaatcagaccttggcgatgaccttgagcagtaggacgtaaataactcccacaagcttcgtgttccaataatagaacactaggcataaatgggttaatcccaccatatcaaaggtgtgtttcagagtacaggttctcaaagtgtgttccctaaaccagcaggccaacagcactggcatcacctggaaaccggagaaatgcaaattgttgatccctccccaagacctacttaatcagaacctctgagggtgggcccagcaatctgggttttaataagtcctgcaggtgattctgatgcaccttaaggtttgagaaccgctgctatttaatataaaggcttcctgtggtccctcaccctctgagtccagctagagctatgaaaaccaaattagcttccagagttttgtcgggggggttttaactgacaacatatagttgtacgaatttatgggtgattttatgtgatgttatgatttctgaatactatgtagaataattaaatctagctagttaacatttccatcacttcaaatattaaacattgtttgtggtgggaacgattgaaatttactctcttagcaattttggtatatacaatactctattattaactatattcaccacactgtgctagtactcaagaaaagaaaagaaaaaaacatattcctcctgagattttgtacccctttgaccattatctccccattctcccaccctgccggcatcggtaaccacccttctactctctgcttctatgagcgtaattgttttagagtccacatataagtgagaacacatgcggtatttgtctttctgtgcctagctcattccacttagcatcagattctccaattccatccctactactgtcataaatgacagaatttccttttttaagactgaatagtattcccctgtgtatatataccaaattttctttatccatttgtttgttgatggacatttagattgattccataacttggctattatgaataatgctgcaatgaacatgggagtgcagacaaatcttcaacaaactgatttcaaaaattttgagtcacctgcaatcccagcactttgggaggccaaggcagatggatcattgagaccagcctggctaacatggtgaaaccctgtctctactaaaaatacaaaaattagccgggcgtggtggtgcatgcctgtagtcccagctactcggggggctgaggcaggggaatcacttgaaaccaggaggtggagggtgcagtgagcggagatggccccactgcactccagactgggcaacagagcgacaccctgtctcaaaaaaaaaagaaaaaaatcctttaagtaagtagccggaagtgggattgctggatcaaatggtaattctatttttagttgtttgaggaatgttcatacagttttccataatggctgtactaatttacattcttgacaacagtatacaagggttcccttttccccacagcttctagaattttctaacgtggtcattacttacataaagccatagactgcggggatgaaatcccaagagctgagaaggaagaaggagaggcaaatgattaccactaggcttcccacatacatcatggcatactcccaagaaaagatccagaaggctttgctcttcattttcacaggtatgtactgccgctggagagaaggcaaagtgatataaacttagggatgtaaacaacagagggcagctattagcttacacttaaagatccctcccgcaaaaccatactatgatacacaggtttataattttgctttggtctttaattaactaagaaggatgtaagtgttaaaaaggtattacgggtgcatcctctgacctcagacctagtaacaccatttctaggtatgtatcctggagacaagttgcagaagatacaaatggaggaagattcattgcaccattgtttggaatatcaagaaaaaatccttcaatagaggaacaaataaattgtggtatattgacatatggtatactatttgccaggttaaatgaatatattgtatctataaatgtcaacatggctagatctaaaaaatatgaggttagttataatagaaaattgctaaacaagcctattatatgaaaatacttatgtgttctgagattataccaaataatactattatttacacacacacacacacacacacacacacacacacacacacacacatctgtaagtttcataaaacatagattagaaggacatatactaaagttatgatagtattagcctcctgggaaccagagaggaaaatataattggaacctaagaaacttcatataacctggcattcatatgcaaaatgaaaagaaataaacaagtaaaaaaagactttaaaaaaacgccaaatttgggttaaaaaaacttcaactttatctgctttcctttgtttgagacagagtcttgctgtgtcgccaaggtagagtgcagtggcacgatctcggctcactgcaacctctgcctccaggttcaagcaattctcctgcctcagcctcccaagtagctgggactgcaggtgcgcaccaccacacccagttaatttttgtatttttagtagagacggggtttcaccatgttggccaggatggtctccatctcttgacctcgtgaatcacccaccttggcctcccaaagtgctgggattataggcgtgagccactgcacctggctttttttttttttttttttttttttgaaacagagtttcgctcgttgccctggctggagtgctacggcgtgatctcggctcactgcaacctccacctcccgggttcaagggattctcctgcctcaccctcctgagtagctgggactacaggtgcctgccaccacgcccagctaatttttatattttcagtagagacagggtttcaccatgttggccaggctggtctcaaactcccgacctcaggtgatctacccgccttggcctcccaaagtattgggattacaggcatgagccactgcgcctggcctcacatattttattaagtatgacaacagcaattatgaaacaatatagcaaaaatcttaatatctgtttagtttgggcagtagacatatggctatcattatacattttctaaatttttcctctcttaaaaatgttttcctcaaaaaaaaaaaaagatgctgggggaagagaaataatttattgttgtaagaaaaaggaaaataagaattaccagaaaacaaaaaaaccaccccagtatgtgagaaaacagaaatgagtttaaacaaatcacaatcaattcaaatgaacaaaactgtataactaaaaatcatgttgtcagggactgggcatggtggctcatacctgtaatcccagcactttgggaggccgaggcgggaacatcacctgaggccaggagttcaaaaccagcctggctaacatagcaaaaccccatctctaatgaaaatacaaaaattagctgggtgtggtggtgtccgcctgtagtcccagctactcaggagactaaggcatgagaatcacttgaacccaggatgcagaggctgtagtgagccgagattgcaccacggctgcactccagcctgggcaacagagcgagactctgtctcaaataaaatagcgtaacgtaacataacataacataacataacataacataacataacataacataacataacataacacaacaacaaaataaaataacataaatcatgttgttaggaaaaaaatcagttatgcagctacatgctatttacaagagatataccttaaaatataagacacagaggccgggcgcggtagctcatgcctgtaatcccagcactttgggaggctgaggcaagcggatcatgaggtcaggagatcgagaccatcctggctaacatggtgaaaccccgtctctactaaaaatacaaaaattagccaggtgtggtggcaggtgcctgtagtcccagctactcaggaggctgaggcaggagaatggcgtgaacccaggaggcagagcttgcagtgagccgagattgcaccactgcactccagcctgggcgacagagcgagactccgtctcgaaaaaaagagaaaaaaaaatatatatatatatgagacacagaaaagctgaaaatcaaaggactttttcagattgccatggaaacattaagcaaaagaaagctagtgtggttatactattatcagataaaatagacttttatgtaaaaaagtattgcagagataaaaatagtccaataatgataaaaggctccattcattggaaaaatataacagttctaaatttgaatgtaactaataacagtctcaaaatatataaaacaaaagtggattaagctacaaaggaaaaatagacaaatccatcatcaatgcataattgatagatcaagcagacaaattagtaatcaaatagaaaaaatgaagcacatttcacaagtttaatctcataagatcttacaaatcatacttatatagagcagggcacctaataactaagtaattcacattcatttcaagcattttgggggtatttacaaaaacatcacatacttaaatcagtccataaacccacattgacttcaaggaatctttatcatacagacttcaatctctgacgataatggaattaatagaaattattaatgaaaagataacgtaaaataaattagaaaaaaacttgctgacctcacatatgtatcacttatttgttgtgagaacacttaacatctattttcttagtaattttcaagtatacaatatattattaactatagtcatgttgcataataaatctcttgaattgtattataaaaaattaaaacacttttccaaataacctaggagtcaaagagaaatgatgtcagaaaatacctcatattactatttgtgtaatgtagataaaacaatactctgagggaaaagtacagccttagaaatttactttggtaggccggcgtgttggctcacgcctgtaatcccagcactctgggaggccgaagcgggtggatcgcgaggtcaggggatcaaaaccatcctggctaacgtggtgaaactctgactcaactaaaaatacaaaaaaattagccgggcgtggtggttgggcgcctgtagtcccagctactcgggaggctgaggcaggagaatggcgtgaacctgggaggtggagcttgcagtgagccgagatcacgccactgcactcgagcctgggtgacacagcaagactccgtctcaaaaaaaaaaaaaagaaatattaaagaaagttactttggaatagaagaaaaattgaaaataaataagctaaacacccattttaagatattagaaaaaacagaataaaccccaaaagaaggaagaaaataataaagaacagaatttgttaaaacagaaaataaaggtacaatataaggaatcaacaaaaccaaatctagttcttagaaatgactcatgttattgatggctttctaataagaataattaagaaaaaaaaaaaaaagagagacgaacaaataaacaacattagaaatgtaaaagagagcataactatagatgtatcagggaggagaaaatattttaaaacttatgccaatgtattttaaaaaaggtgaaatggaaacattctatgaaaaatataaataatttaaatgattaaaaatgcctgtgtaactaaaaagaagtggagatcaaaggacatgacaatgaaatgtaatacatcctgaaccccatcccttcccccaaatcctataaaggtcacatataaattggggagtttgaatttggagagaatatattggataatgttattctatcaaggttaaatttctaggggtgataacagtatcatggttatataaagaatgcctagttcttaagagttacctgctgaattagggttgatgtgtcttgtctgtaacttccaagcaagtaattcaagggaaaaaagaaaaatcaacatatttacatagatatacataatatggcaaaatgataactgaagaatctttaaaaaggtatttataatattatagtactaaatttttctgaaataatgaaataaaaaattagagaaaaaattaattcacaagaaaatagaaaattggcccaggtgtgatggctcatgtctgtaatcccagcactttgggaaccagaggagggtggatcacttgagctcaggagttcaagaccagcctgagcaacatggcgaaaccccatctctacaacaaatacaaaaattagtagggcatggtggcacatgtctgtagtcccagctactccagaggctgaagtgggaggatagcttgaacccaggaagggaagtgaaggttgcagccaatatcgtgccactgcactctagcctgggcaacagagcgagactctgtcttaaagaaaaaaaaaaaaaagccaccaagccactttacgtagataaaaagttcatatggaaaaacaaacatgcaagaatagctaagaaaacactgattaaaaaaatcatgaagggggactagccttatcagacactgaaatataaaacctctataattaaagcagcgcaatattggctcgttaatagagaagtagactagtagaataaaacagaaagtccagcactagaccaaaatacatatggcaatttagtatatgacagtggtggcatatcactatgataaaaattgactttttaatcaatgatgctaggacaacaaggtaaccatttggaaaaggttgaattagacctatctctcacaccattcacaagaataaactccaaatagcttagggatccaaatatattttttaaatgaaatgataaagcactgtactagaaaaaaacatggtgaacttgtctttaactttgatgtagaaaaaagctcaactgtgattgtgccactgcactccagcctgggggactgagcaagagaccctgcctcaaacaaacaaaaaacaccaggcatggtggctcatgcctgttatcccagcactttgggaggctgaggcaggtggatcacttgagtccaggagttcaagaccagcctgggcaacatagagaaaccctatctcaacaaaaaatacaaaaattagccctatgtggtggtgcacacctatagtcccagctatcagggaggctgaagtgagaggatcacttgagcccaggaggttgaggcttcagtgagctgtgatcgtgccactgcactccagcctgggctgcagagtgagaccctgtctcaaaaaatcaatacaaaacaaaactacatacatacttcaataattccactttctagaaatctatcttgaagatatacctccaacaatatgaaaataagtatatacaaggttactcgctgaaacattacttgtaattgcaaaatattgtaagcaatctaaattcccacacactggagagcggctgaataaactatggtatattcacacaatggcgtactacacagccttaaaaaagaatgaggacaatctctattctatctatactgatatggaggaatttccaggaaataatgttaagtgaaaaaaaggaaagcacaaaagagtatctaaagtatgctacccttcatataagaaaggcatataagaggtgggcaaatcacctgaggtcagcagttcgagaccagcctgaccaacatggtgaaaccccatctctactaaaaatacaaaacttaactgggcgtggtggcaggcgcctgtaatcccagctactcgggaggctggggcaggagaatcacttgaacccgagaggtggaggttgcagtgagccaagatcgtgctattgcactccagcttgggtgacaagagccaaactctgtcgctaaataaataaaggcatacaagaaaatatacatataggctgggcgcagtggctcacgcctgtaatcccagcactttgggaggctgaggcaagcggatcacgaggtcaggagatcaagaccatcctggctaacacggtgaaaccccgtctctactaaaaatacaaaaaattagccgggcatggtggggggcgcctgtagtcctagctactcgggaggccgaggcaggagaatggcatgaacccaggaggcggacggagcttgcagtgagccgagatcgcgccactgcactccagcctgggaaacagagcaagactccgtctcaaaaaaaaaaaaaaaaaaaaaaagaaaagaaaatatacatatatacatgtatctattcactggtgtgtgaaaggaatacaggaaagataagccagaaactaaagagaagacagccctccatatccatgggttccacatctatggattcaatcaactaaggataggaaatattccaaaaaaaattgtgtctgtactgaacatgtagagatgtttttctttcattattccctgaacaatacagtataagaactatttacattgtatgaagtattacaagtaatctggagatgacttaaagcataggagaggatatgcctaggttatatgcaaatactatgccattttgtattagggacttgtacatcctgagattttggtacctgcaggaggtcctggaaccaatccaccacaaataccgagggaagactgtaattacctagggtgagaggggagggactagaagaacaggatagcaggaatgatgacagagtaatactgctctttttgtacagctgactcttagaaccacagtaatattttacattcccttcacttaccccctcctcaaataaacaattaaaatcaaccaatatgtggggagaatccaaaatgaatataaaccctaacaaatgaaactaactatattacaaattaaaaacacaaccacactgaagggttacatggcgcaagaaaagaactaatctaagtaattatgaaaaacaggccaggcacagtggctcatgccttaatcccagcactttgggaggccaaggtgggtggatcacttgaagtcaggagttcaataccagcctggccaactaaaaatacaaaaattagctgggcgtggtagtgctcgcctgtaatccaagctacttggcaggctgaggcaagaggactgcttgagcccagtcgggcgatggagcgagaccctgtctcaaaaacaaaacaaaacaaaaaaagttacagtggagaaacctggcagacactaacgtcaccaagtgatcaaggtaaacattagcattgagaagatatggcaatatcatgaacccctcggtacagtgcactgaggacacaatatgcatttttgccaaaaacatgtaaattcagtccagtcatgagaaaactatgacaatctaaactgaggtacatttcacaaaaataacttcacaagtcatgaatgacaagagaagactgaagaactgtctcagactaggacagactaaggagataaaaccaccaaatgcaatgtgggacctaaatatgatcctgaaacaaacaaaaatagcctcagtagaaaatgcaaaattctaataaggtctgtcgtttagttaataatgctgcataaatatcaatttatttgttcttgataactgtatatggttatataaaatgttaacattagcggaagtggagtgagggatacaagaaactctgtactatttttgcaacttttccgtaggtctaaaattaattcaaaataaaaaacttttaaaaatggagataaaaccatctgttacatggttggttaaaaaaataaacaagcaatttaaaaaattagagcgttctacaaggccagtataaaaaaaaatcagccctttgccttgcctctaatcttcattaaatcaagcttgttattgtgatgttcaaatcgtttacatagttattaaatattttggctgtttaatcttactttgagagatttgttaaaactaattacgatggctgatttatcaatttcttctagctgtgtcaattgttattttctaaattttaaagatatcttattagtcaaatacaagtttgaattctcaaaaacaaagcaaaataaacaaaagacaagcagaacttcacgaagatataccactagaattgccaacattaaaaagatcgataccatcaaatgttagtgaagatgtgtggcaactagactgtcatatttggttgggggggttgtaaaatggtgcaaaaactttgaaaaactgtctagtggattctagcaaagctaaacgtacacttgcccaatgtcccaaaaattctgctaggtactgctcaagagaaacaaaaatgttaagtccacaaaaaaacttgtaccagaatgttcatagtagtctatttgtaacagacaaaaactggaaatgggcccaagtttctaccaataggagaatgggtaaacaaaacgctgcacacacaaaaaacacccagcaataaaaaagaatacatgcaataacatggataaatctcaaaaacaagctggttgaaggaagccttatacaaaataatcctattatttcattccatttatatgatgttttagaataggccaaactaatctatggttaaaacaatattcagaacagttgtgtctgaggaaataggagtgggaattgatggggaaaggacccgaagatactttctgtattttgagaggagtttgggttacacaggtatttgtattaagattcatgcacttcatggtatgtaaattctacctaaaatgaaaaagagtgtaaataaataatgaactccagttgatgcttatgctgaattatttacaaggatatgtatgacatctgcaatttacttcaaaatgtatgaaaaataagactgactgatggatagatggatatgtgataaagcaagtatggtaaaatattaatggaggaatgtaggttataggtatatgagtgttcgtatttgttttttctttgaaatttttcattacagaatgttgggaaaatgtaagatttaatacactgtttagcaagccatacatatgtggtaacactttcaagaaaagccaaagaatgattaacaaaaaattcacggtaggccgggcatggtggctcatgcctgtaatcccagcaatatgggaggctgaggtggtggatcacctgagcccaggagctcgagaccagcctgggcaacatgatgaaaccccatcactatatatttttaaaaatatataaataataacaaattcagggtagtcataacctctgaggtagagggaaggagtgcagtgtagaaggaggacgtacagggcttctaaaggactagaaatgttacattacttaagcagggtagtggaacacagtgttgctttattatgttttaaactatgcaaatattataaagcacaagggcattcaagacagatgggacatcatgggtatgggacctgaggtgggatggaacttgccacactggaggaacagagaaggtctgtgtggtttgagatttaggagtgaggggtaagtggtataagataagcatagagaggtagagaacagccaagtcaaggaggagctaagccattttggtaatatacatctcataggctctttaacagttgagaaaaatgtttcaggtggtgagtgttagcacctcttttacaatcttgtgacaaagaaagcaagttccagaccaaattctagcacacctaaagacatctattaaacagatattccttagtgagccaggcccaaagcagttcacacaaactattctagaagctccatgctgtcccagctctttctgcctctagttattccaaccaccacttatgaaaaaggttcactcataatagaactgacaatatcccagaggcagggttctgttgcccttggagtcacatcaggcaaccagaaatcctaaccaaaggccaaaggatcattaaggaattacgcctcaggcgccatctccaagggaagaagttacaggccctgctagattcatattccttcttcatgcaagcataggaatatttcagggtctcgctttgttgcccaggctggtgcagtgacaggatcatagttcactgcattatttgggccctaactcctgggcccaaataatcctcctacctcagactcccgagtagctggaactacaggcacatgctaccatgcctggctaattttttcattttttgcagagatagggtcttgctctgtagctcataagccaccacatctggcccaattctgcttttgaatacttcaatttcactaatgagcgcctacttctaatactcattttgttaatcagtaagacactaatctcaccagtaaaaattggccaggtgcagtgggccatgcctgtaatcccagcactttgggaggccaaggtgagtagatcacttgaatccaggagcttgagaccagcctgggcaacatggcaaaaccctgtctctacaaaaaatacaaaaattagcaaggcatggtggcacgcgcctgtagtcccagctactcgggaggctgagacaggaggattgcttaagcctaggaagcagaggttgcagtgagctaagatcgtgccattacgctccagcctgggcaacagagacccccgtctcaaaaaaacaaaaaaatccaagctgtttctgacagtcactatgctaactagtaaaggtgttgatcaaactatagagagtgctgcactgatggcagcccctggagagtgcacccttgaagatgtaaagctaggtgacatcatggaatgtggatgcttcattaatgtaattcacattcccctgaagttgaggctgaaactaactggcaaatatatactatcagatggtctatgaagaagtatttttaaataaattacagacatcataactccatgataaagactttaaggatgatggaagtcagcgaagagttttaagctggagacagcattactgttaatagatcttaggtgagaggaatctgaccaacgttatggccccccctgtaagctttacacacatagctctactctgacttctccttgcaactgtactgtcccctagccatatgtggctattctaatataaagtataacttaactaaaactaaaacttcagttcctcagtcccactagcaaatttcaagtgcctgatggccacatgtggcttgtgtcttctgcactgacaatacagacacagaacatttccatggtcacaaaaagttctactgataccgctgatctagaagaataaagtttcaagagaatgataaatttctggggatggaaaataattcaaggccaggcatggtggctcaggcctgtaattccagcactttgggaggccgaggcgggcgggtcacttgaggtcagaagttcgagaccaacctagccaacatggcgaaaccctgtctctactaaaaatacaaaaattagctggacttggtggtgggcatctgtaatcccagctactcgggaggctgaggcaggagagatgcttgaacctgggaggcggaggttgcagtgagccgagatcatgccattgcactccagcctgggcgacagagaaaaaagagaagagaagagaagagagaaaagaaaagaaaaaagagaaaagagaagaaaagaattcaacaaagagaaggcatccatagataaattcaatgaagaaagtatttaggttctgagttaattccttgatcatcttgatcttcctcctgaaaaagactgccatttagcaaagaagggaggaagaaaaaaaagaggaagaaaacagcccaggagagaaaaaaaaaataccctctaaagtaaaaatattgttttgtcttcccattccaccctactgatatttaaaaagaagtatgccagggaataaaacaacaaggccatgaaaaactgaatcaagtaggctgttaaaagcagttattggccgggcacggtggctcacacctataatcccagcactttgggaggctgaggcaggtagatcacctgaggttgggagttcgagaccagcctgacaaacatggagaaaccccgtctctactaaaaatacaaaattagccagacgtggtggcacatgcctgtaatcccagctattcgggaggctaaggcaggaaaattgcttgaacccaggaggtggaggttgcagtgagccgagatggtgccattgcactccagcctgggcaaaaagaacgaaactctgtctcaaaaaagaaaaaaaaaaaaagcagttctcttaggcaagtcctgaacacacactcaggaaatgaggtttcactctttgcaaatcccattagtggcccccaagtttctgtttgctaccatttttctcagtgttttattcgacctaaagtgctctcagtgttagactggaaaatgattttttttcttggcaaacttgtggttacaagatgtgcaataaattttaagtataattctgttttgaagacatggttttggagtcaaggtttgcttggggaacagggccctaaaacgataaagtaatttgaagtatgtactgcatctatttataaaaactgaacttgcacttaatcttgcaggactattccagttacacagtgaggcacatctaaaattcctaaaaaagaaactccagcaatcccctgatggcttgttgtttataaacactagagccaaacttaatctcgaggttgtaaaagttgattatataaattgggtcattcttgtcatgtccaacgaaatcagggccaggggaaagaacacccagggcatacagcacctgctccaagaattagattttccacaagcccagctgctgaaacgacctgctgtgactctaagactactttaacctaccactgtctcaccaatcagagattcccagctcccaaaaacttgacttgtgtcaatgagctttctttcaaagcaatacatactatttctttttctaataaaactcctaaccttctgtttgttctttggacataccaaagaccacccagtctgtgtgtataactcaaattgcaattcttgcttcccaaataaaacattagagatttgtctctatattttatttgacttcaacaaggttcacactgcaaatttcccagtgaacaggtgagatttcatcttacctcttttgctccacagcaaacgctgacttaaaacgtgtatgtaaaatgtatgtatgggctgggtatggtggctcacacctgtaatcccaaaactttggaaggccaaggcgggcagatcacctgaggtcaggagtttaagaccagcctggacaacatggtgaaaacccgtctccattaaaaatacaaaaattagccaggtgtggtggtaggtgcctgtaatcccagctacttgggaggctcaggtgggagaattgcttgaacccgggaggcagaggttgcagtgagccgagactgcgccagtgcactccagcctgggcaacagagcaagactccatcataaaatgaaatgaaataaaataaaatatatgtatggctgggtgcggtggctcacatctgtaatcctagcactttgggaggccgaggtgggcggatgacttgaggtcaggagttcaagaacagcctggccaacatagtgaatccctgtctctactaaaaatacaaaagttagccaggcgtggtggtgggtgcctgtaatcccagctacttgggaggctgaggcaggaaaatcgctttaacctgggaggtggaggttgcagtgagctgagattgtgccacagcactccagcctgggcgacacagcaagactccatcttaaaaaacaaacaaaaaaataaaatgtatgtatgtatgtaagtagaagggttacaagaatgatgccctaaaaactctatcaattttttaaaccattttattacaaacacaaaatgcaggaaattacatagaatataaagcttaatgaatgattgtaaggtgaacatccttataaccactaccaaggtcgagagaaagaactttccaggcattccccaagttcctccatgttccctgatccaaccacaatcccctcctccctccaaagtaatcactaccctggctttggtaataatcacttccttgcatttctttatggttttccacttacatgtgcatccctttctatagtttaggtcttgcctatttttaaaatttttgatacaatttttaagtctcttaattcataattcctccactccagcctactcctgcccatatcttttttttttttcttgttacaattcatatgttacagaatctgggacatttaacccatataacatcccataatctggattttctaattatgtaccttgttttcagtatttcttgcaaattgcagctatatccagaggcttgatcaattttggattttatccttttggcaaactttggtggtgggtaatgttcttttgtcaggaggcttggtttttgtttctgatgtcagcagttattgatgctcagtacctagaccataaggggttgtaaaatgatgctatcctatcattttgttttcatttgtaagttgaaataattttataaagatatatttctgtcacctactatatggttatctagtggtacaggaaaggcaggacaaatacttatttttttcctttatccagttttcaatacaatgaactgatttcttatcaattctcctaatttagccaagtaggtttcctttttagtaacattatgagtgcctggatttaaatatatttatgagttttaatctattgcaattcttaccttactgaaactcaaattatccctctttggtcagtgggagcctcttcaagttagatcctaagtcctttcaagatgactccagtagactttgataaactttcatgttatctgttatcacaacattctaggatcatcctatacatttcctgccctaaaacctagaattagccatttccctaagaaaccccagtttctctaaatgggtaaatggtatttcaagatcataatttgggcactaagaatgttcattcatactgggttggtcattgtttctagaccttttagtggacagacacacacacacacacacacacacacaccacacccctacaggggaccaggcaggtaacaaacaagtgaaggtgagagaaatgaaacagggactgtggcaatctgaagagggtacgctctgcctaaaggggacagatcttacaattcctcaaaaggagccagaaataaaaaatttccacatgaatttttaaaatgctgactactaatttcaaaaaagtcaaacaccagggtcaaatgaaccacatctgtggggccagatgtgatccaagggttatgtgcaccctcaacctgaaaatgttaactcgcagttacaatattccaggagtcacattgttgctaatatataaaaaatatttagggaaattaagaattctcagactgcttcagaaaaaccccagctacattaagattatcttcctctccccaagtctctacagcactagggagaaaagcattttctgtacagaaaccatttcctttctcagacacgatgtgaaagggaaaaagccagttatccaaataaactcttaaagggagttaacctaacaatgtttttacatgtaagttcttggaatcacaagaagagatccaggagatatattttgcatgacagatatattagaggaaacaaaactggtagaaaactttattgaaaatgcttgatcaagctcttgccttcatttttacccattccaaaaagaaacaaagctaacagcactgctacctctgccctagcacacacctggacatagcagaaataacagaaagtgactggggaagaaaaaataaggtgtgaaaactctaaatatggccccagagaaggcttggggaaggacccgttatcaagaaataactgattgagtttggctcctctggtataagctaccatcacataacctgacccaagctccagaaaggataaaaaaaaatcacaggattaacgttttcagttcaaagacaagaaaaggtcagactggattaaagcaaaaccaaaagagtactcacggggtaatttcccctagtgtctgctactgtctttgaaagaaaataaaggcctcaaaccatccaagggaatccaaggctttaggaatcccaagcaaaaggaagatgggaactagaaacttcccagactgcaccatgagcatctcggtaagcctcgcctggtctccctcgaagccttacagcttcagcttctcggtcctgtgcactcggctttccttcactggagcctcctgcccctgagcatgttagggctatttttttccgcatgctatcaaatcataacattttaaacctctctctaatttggaaactaggctctcagccaaggtcagagaaagagttgagttgccggatggaaccagatgggctcaaactaccattctcataagtgattcaccagggagccagatgcagcatcccctccctttgatcttgtgtctcatgaaggaaaggaagaatagtttcacctctggcactgatcagacaccagtactctctagaaattccaccagcagaatggaggcatgtttatagtgtcaaaggaggaagtacaaactaacttttacagttcctttgacttcaaaagatgaattattttcttttcccctcatcgccccacatactggtgatcatgtcctttcatgaacatttgaatactaataatcatagctaatatctatcaagccctcatcagactctgttctaaacacttgacatgtattaaccctttgcagtaggtactattatattatccctgtggaagcagagaagttaaatagtcacttgctcagggtcacagagttaataagtgtccaaatgaagacatcagagcctgtactctatttccctcttttttattataaattttttcaaacatgcagaaaagttggaagagtaatacaataattaaccatatatgtctagattaaatattaataccttgccttattttatctttctgcatgcatatatttatttttgctgaaccatgtaaaagttgaacacatcatgacatttctctccaaaacacttctgcacacagttgtgcaaaataaggacattctcctatataccataatactatcatcacatccaggtaatcaacaattcccagccggcgcagtggctcacacctgtaatcccagcactttgggaggctgaggcgggcggatcacaaggtcaggagatcgagaccatcctggccaacacggtgaaaccccgtctttactaaaaatacaaaaaattagccaggcgtggtggcaggtgcctgtagtcccagctacttgggaggctgaggcaggagaatcgcttgaacctgagaggcggaggttgcagtgagccgagattgcaccactgtactccagcctaggcgacagagtgagactccgtctcaaaaaaaaaaaaaaaaaaaaaattccctaacatcatctaatatctaatctgtcttcaaaattttctagttgtcccccaaaacatcctttatagctgtttttttcaacccaaaatccaatcaagactctcccattgcattcagttattgtgtctctttagtccagaacggtttctccactttttctttttcataacattaacattttgaacagactcagaccagctttcttaaaataccatagtacattctggtttgtcttactgcttccttgtggtgtcattgaactcgttcctctgctcttttattccctaaaaccaaaactcagatcttaaggcttcattaagggtaactttttgggtaagaatagttcagagttgataacgtgtattttgtactgcctcatgccaagcactatatatatcatgtcaagttgttccactataagtgataagagttggattacttagctacagaatatgcctttgtaaagatttttgtttgtttgttttgtttcgtttgtttttgagacagtctcttactctgtcacccaggctggagtgcactggtgtgatctcagctcactgcaacctccgtctcccgggttcaagcaattctctgcctcagcctcctgagtagctgggattacaggcacccaccaccaagcctggctaatttttgtattattagtagagacagggtttcaccaccttggccaggctagtcttgaacaactgacctcgtgatccacccgcctcggcctcccaaagtgttgggattacaggcgtgagccaccatgcccggccataaatatgtatttttccctttgctattagcaaagaatctagagggtggggactagggaataatgttttgacacaatgcaaatgcaaatacattgttctctaaaaaccattcacccagtgattttagcatccatgtgatatgcacaagaggcaggtagaaaagggccgttcctggcgacggccccaccctcaagcctggacccctgacctaaagtgagaacttcacatccctgttgccttttccaaaaccaccctggcctggcctgccccgcatcctgtactcataaaaaccccaggctccactggcagtggagtggcagagagggagagagaagcagcagccagaagtcagagggaagcagcttgatttcagacggacaccttgatggcgggacctcggagaagagttcagccaggaatgaccgaactgaggggaagaccaccttcctgctccatcccctttccagctctccatcccattgacagccactttcatcagcaataaaatcccctgcatttaccatctccaattcatttgtgcaacctgatacctcctggatgccaaacaagaggttgggatacagagggctgtcatactgagatgtgaaatgcttaagccatcagaggatggcaaagctgaaagagcacagtgtaacaaacaacttctgtggctccagggatcatgagtaccccactagacattgctgtgggactgcacagagttgtgcacagagtctgtgccatgggactgcacagagttgtgcccagactggtcttaaactcctgggatcaagtgatcctcctgcctcagcctccctaagtgctgggactataggtgtgagccactgcacccagctataattcctttttaaaaggcagagtaattgcttagttctttccttttaattatttactttcagagtgagaaactggtaaaatagccacatctgatgatggtctatgtattttttctcttcttgcccttttagtgagcatcactatggagacatgacttttttttttttttttttttgagacaagaatcttgcactgtggcccaggctggagtgcagtggtgcgatctcggctcactgcaacctctgcctcccaggttcaagcgattctcgtgcctcagcctcccaagtagctggcattacaggcacccaccaccatgcctggctcattttgtattttcagtagagaaggagtttcaccatgttgtccaggctggtctggaactactgacttcaagtgatccacctgccttggcctcccaaagtgctgggaatataggcgtgagccaccgtgcccagccaaacacatggatttttatccagtgttttataattacttgttgtcattcttttgatgctcagaaattcccaaatttgggtggtatgagcccctttcagctggtaccagtgtttttctgacttagtcctgttaagactttgaggactattttgcttttttttgttgttgtaacaagatgtcccagtcaagctgtgctcttacatactacattagacaacctttcctagagggctatgcctacagagggcttgaaaaaaactcagagaaaaagataatgtcaagagcagatgtgtcagctcctagaggttatcaaatccattttgatttggaagtagaaagcattctgaagccgatcagggtacagccactcactctggcacttacagctttgctacaactccccagcaagtggccattcagcctctggcctaaacaccatgattcacagggaactgacctcacttaggacatctcattctgtcacagaactaccttatactaagcttcttgtaccacctaaccattagttctagcttctctccttggagcctatggatccctgtgaaactcaactctaaagggtccacttagtagtctggcagaaactcagccctaaagaataattttaggctggttgtggtggctcagcctaatcccagcactttgggaggctgaggcgggaggattgctgtagctcaagaattcaagaccagcccgggcaacaaagtgagaccctgtctctaaaaaaaaaccaaccaaccaaccaaacaaacaaaaaacaaaaaacaagccagccatggtggcacatgactgtagtcccagctactcagtaggctgaggcagggggactgcttgaacccaggaggtctaggctgcagtgagccatgttcacagcactgcactccaacctagttgacagagtaagaccctgttacaaaacaaaaaagaatatttcctcttctgtttccaccttcactttttttcaccttttttgttttttttttgtttttgagatagagtctcactctgtcacccaggcttgagtgcagtggcgcaatctcggctcactgcaacctccaccttccgcgttcaagcaattctcttgcctcagcctcctgagtagctaggactgcaggcacatgtcaccatgcctagctaatttttgtacttttagtagagacgcggtttcactatgttggccaggcttgtctcgaactcctaacctcaggtgatccacccaccttggcctcccaaagtgctgggattacagacatgagccattacacctggctcctccttcatatttaaacagatggttttgtttcctggatgtgactacactgatcttcaaataccctaccatgacccacaaggcccaggtgatataatttggctgtgtccccattcaaatctcatcttgaattgttgttcccataatcccctcatgtcatgagagggacccggtgggaggtaattgaatcatggggatggttacccccaatgctgctgttctcctgatagtgagtgagttctcacaggatctgatggttttataagggtcttttccctctttgcttggcacctctccttcctgccatcatgtgaaggtggacgtgtttgcttccccttcggctatatttgtaagtttcctgaggcctccccagccatgtggaactgtgagtcaattaaacctctttcctttgtaaattaccaagtctcaatatcatactgaatggacaaaagctggaagcattccctttgaaaactggcacaagacaaggatgccctctcttaccactcctattcaacatagtattagaagttctggccagagcaatcaggcaagagaaagaaataaagcgtattcaaataggaaaagaggaagtcaaattgtctctgtttgcagatgacatgagtgtatatttagaaaaccccaccgtctcagcccaaaaactccttaagctcataaacaacttcaacaaagtctcaggatacaaaatcaatgtgcaaaaatcacaagcattcctatataccaattatagacaagcaaagcgccaaatcatgagtgaacgcccattcacaattgctacaatgagaataaaatatctaagaatacaacttacaagggatgtgaaggacctcttcaaggaggactgcaaaccactgctcaaggaaataagagaggacacaaacaaatggaaaaaaattccttgttcatggataggaagaatcaatatcatgaaaatggtcatactgcccaaagtaatttatagattcaatgctattcccatcaagctaccattgactttcttcacagaactagaaaaaactactttaaatttcatatggaaccccaaaagagcctgtgtagccaagacaatcctaagcaaaaagaacaaagttggaggcaacaagctacctgacttcaaacgatactgcaaggctacagcacccaaaacagcatgctactgctaccaaaacagagatatagaccaatggaacagaacagaggcctcagaaataataccacacatctacaaccacctgatctttgataaacctgacaaaaacaagcaatggggaaaggattccctatttaataaatggtgctggggaaactggctagccatacgcagaaaacagaaactggacccctttgttacaccttatacaaaaattaactccagatggattaaagacttatacgtaaaacctaaaaccataaaccctagaagaaaacctaggcagtaccattcaggacataggcatgggcaaagacttcatgactaaaacaccaaaagcaattgcaacgaaagccaaaattgacaaatgggatctaattaaactaaagagcttctgcacagcaaaagaaactatcatcagagtgaacaggcaacctacagaatgggagaaaatttttgcaatctatccatctgacaaaggtctaatatccagaatctacaaggaacttaaatttacaagaaaaaaaacaggccaggtgcggtggcttatgcctgtaatctcagcactttgggaggctgaggcaggcagatcatgaggtcaggagattgagaccatcctggctaacatggtgaaaccccgtctctactaaaaatacaaaaaatgagccaggcatggtggcacgtgcctgcagtcccagctacttgggaggctgaggcaggagaatcgcttgaacctgggaggcagaggttgcagtgagctgagattgtgtcactgcactccagcctgggcaacagagcaagactcaagtctcagaaaaaaaaaaaaaaaaagacaaaaaaaaaaaaaccaaacatcaaaaagtgggcaaaggatatgaacagacacttctcaaaagaagagatttatgtggccaagaaacatgaaaaaagctcatcatcactggtcattagagacatgcaaatcaaaaccacaataagataccatctcacgccagctggaatggcgatcattaaagtctggaaaaacagatgctggcaaggatgcggaaaaataggaatgcttttacatttttggtgggaatgtaaattagttcaaccattgtggaagacagtgtggcgattcctcaaggattagagccagaaataccatttgacccagcaatcccattactggatatatacccaaaggattataaagcattctactataaagatatatgcacacgtatgtttactgcagcactacttacaatagcaaagacttagaaccaacccaaatgcccagcaatgagactggataaagaaaatgtggcatatatacaccatggaatactatgcagccataaaaaaggagttcacgtcctttgcagggacatggatgaagctggaaaccatcatccttagcaaactaacacaggaaccgaaaaccaaacatcgcatgttcttactcataagtgggagttgaacaatgggaacacatggacacagggaggtgaacatcacacactggggcctgtcatggggtgggggacaaggtgtgggagagcgttaggacaaatacctaatgcatgtggggcttaaaacctagatgatgggttgatacgtgcagcacaccatggcacattacataggtttgttatacctatgtaacaaacctgcgcattcagcacatgtattccagaacttaaagtaaaatttaaaaaaaaattatttcatgtaccatcagcaaaaacaaataaataaataaataaccaagtctcgggcagttctttttctttccttttcttttttttttttttctttttttgagacagagtgtcacttcatcacccaggctggaatgcggtggtgcgatctaggctcctgcaacctctgcctctcgggttcaagcaatgttcctgcctctgcctcccgagtagctggaattacaggaacactcccccatgtctggctaatttttgtagttttagtagagacaaggtttcgtcatgttggccaggctggtctcaaactcctgacctcaagtggtccacttgcctcagcctcccaaagtactgagattacaggtgtaagctaccacgcctggctcaggcagttcatagcagcgtaagaatggactaatacaccaggctacttcatatatttataaaaaatatacaaatatagtaggaaatggagttttaatttctgcataaatgggatcctgaagttcatctcaaactccttccgctcctgtcccccacatacagacggttaccaagcacagccaattctacctcctagaattcccctgcatctagtctctcatctctccatctcctctgacactggtttgggcccccagtttacccctctgacttgatctagtacaatgttctaagctttcccaacttcagctcttcctactcccatctacccgacaagctgctgccaaagcaatcttcctggagcactcacctgctcagcatccttcaattgctttatgtctgcagtctggcatagtatctagcacactataggtacttagtaaatattggtagaggagctgcttgacttaatgagtcagttgtactgtccactagtgtcaggaggaaatttcctttagttttaaacaaaagttgttttatataaagtggtgcatagagattggcttaagaaaccatttttatcttcttttatttacttattcattttttgcaggttggacaagctcagaaaccatttttaaatttctggtccatccatgtgtatgaatatactatattatttatttgatacatagttgtataaaaagtctggctatatatattcttagtgcttagactttctaaagaataagccataaataggaaataaaaaagaaaatacaagcagcacattgttatgtggaaaaatgcttcaactcagcaagaatacagaaagaaaatcaaagcaaaataacttcactgtatggtgacacatctactgaactggcaatcataaatcaaacttgaaaagtcagtgctggcagatgaggaggtaagtggtccacttctctttagatactgatggtggcactgcaaactggctcaggctttctggtgaacaatctggtataattgcctaataagaacaatacgacttttcaccttgggtccagtgatttagctaaagcaacatacttgaagaaaataatttcaagctgggcacagtggctcacacctgtaatcccagcactttgggaggccaaggcagaaggatcgcttgaacctaggagtttgagagcagcctgagcaacatggcaaagccctgtctctacaaaaaaatacaaaaattagctgggtgtggtggtgcatgcctgcagtcccagttacttgggagggtgaggtgaaaggattgcttgtgcccgggaggttgagggtgcagtgaaccgtgactgcggcactgcacatcccatcctgggcaacagagtgagacactgtctcaaaaataagaaaaagaaaaagaaaacaaataaaaacaaatttctggctgggtgaagtggctcattcctataaacctagcactttgggagaccaaagtgggtgggtggatggattgcgtgaacccaagaattcgagaccagtctgggcaacatggcgaaaccccatctctacaaaaaattagccgggtgtggtggcacacacctgtagtcccagttactcaggagactaaggtgagacgatcgattgagcctgggagatggaggctgcagtgagctgagattgtgccactgcactccagcctgggtgacagagcaaggacctgctctcaaaaaaaaaaaaaaaaaatttctacgttatttatattagtgacaatataaatgacatatctcaaacataaataaagacatatctcaaattccccaaataagaaaaagatcaagcaaaccatgaatcattgtctgcatcaacacaatattataaaatcacttaaaataacatgcatatggcctatttcaataaatggaatacacactcagctttagcagtgcttgtgattaagaaaggctctgaaatcagacatttctggcactgccacctgtacactttcaagaaacatttatcttgtaagaatggatttggaccatgtggggcctgcatgcagttacttcctcttgaagaaacatgtatgtactattctcatttgagtagaacaagatgattagagagcacgctctggcatcagatggccatggttcatatcttagcaatgtcattcgctggtcctgtgaccttaagtgacttaacctcccaacattctagtttcaattcatttgtctaatatggctaacactagactaatatttggctaataatatgacctactccataaagttcttatgaggttaaaatgagacgatgcctacagagtgcttagcatggtgcctgacatgtaatccattctcagtaaatgtcagcaatttgcattcttcaattaatgtttattgatcagccactatgttccaagcattgtttcagatgcacatactccatttaagtcctataagaatcttacaaggtgagtgttattataaagaaaagttaaagaaatgagctcagaggggatcactagttgagaaaagaaaactgcaagatagttgcgtttgcaaatatgtaaaataaaatgcacttatacattcccaaggatatgcatatagtagtgccccccttatctgaggtttcacttttcatggtttcagttacctgttgtcaactgtggtccttaaatggaaaattccagaaacaaacaattcataagttttaaattgtacaccattctgagtagtgtgatgaaatctcacgccgtcctgctctgtcccactcgagacatgaatcacccctttgtctagtgtatccctgcctgttagtcacttagtagttgtctcagttattcgacagaaaaaacatagtatacgtagggttcagtaccaaatgcagtttcaggcctccattaggggctttagaacatatcccctgcagacatggggaggtctactgtagttgggacttaatgataattaagtccactttgtttaaagttagtcaagtttctatgtgtttatattttcaactgggagcaagcttcccactgcctttactaacccgtgcccttcctttcccccagcagggaccaggccatgtattaaatgtcacttgggtgctggcttctgaccagcaagtgcttacctggaggagatagaggagtcctgggacaaacaaggtgagtgggtacagagactggtatgtcgctaaggcaagaaaaatagcactgaggaaagcactgcctgtaaaaagaaagaaatgtatggaataatccagcctcatcaatcatgattagactcagcaagtccctctcaacacaaaactttccataactgctcaaataatcacctgccaagtgcctcctggtacacaaggtgctatgcaaattcacacagtaagagcttcttggcttgatttccaatgaaaggaaaccaagaaagtcaaaaccatctacctttggcaacctgagacactacaggcataattcttataaaattttgagacccagaacgattttacaaaatttcaacccgaagatgtataaagggatcaagtctattaacatccatgtcctatctaatgtaccaatttattaagcctacaattattgcttatgatatccagagctggaaacccatccctttgactgttgcaacattatcactctttacaacagcccttccttacctgctgcatcaatttaggtcacgttttttcttttcaaatgaaagtatattaattttgttagtaatgtcctcacttcctatataaaatggactactatggaatcattaaacatgaggctattaagaatttgcaatgacttagaaaggtgtttataatatcctattaaatgaagtttataaaagagacatatattatcatttattttataaaaaaaaaatgcacaaacattttttaaaagacgaaaagccagcaggcaaagtaactcacgcctataatcccagcacttcgagaggccgagtcaggcagatcaagatcaggagttcgagaccagcctagccaacatggtgaaacctcgtctctactaaaaatacaaacattagccaggcgtagtggtggtgacctgtaatcccagctactcaggaggctgaggcagaagaattgcttgaaactgggaggcagaggttgcagtgagctgagattgtaccacagcactccagcctgggtgtccaggcaaaagtttgcagtagggggcggagccctcatggagaacctctgctagggcaatgcggaagcgaaatgtggggtcggagcccccacacagagtccctactggggcaccacccagtggagctgagaagagggtcactgtcctccagattccagaatggtagatccaccgacagcttgcaccgtgggcctggaaaagccacagacactcaacaccagcctgtgaaagcagctgagagggaggctataccctgcaaagccacaagggtggagctgcccaagaccatgggaacccccctcttacatcagcatgacccagatgtgagacatggagtcaaagaagatcattttggaactttaagatttgtctgccctgctggatttccaacttgcatgaggcctgtagcccctttggtttggccaatttctcctatttgtaacggatgtatttacccaatgcctatacccccattgtatctaggaagtaactaatttgcttttgattttacaggctcacaggcggaaggcacttgccttgtctcagatgagactttgggctgtgcacttttgggttaatgctgaaatgagttaagactttgggggactgttggaagggcatgattggttttgaaatgtgaggacatgagatttggaggggctgaggcagaatgatatggtttggctgtgtcctcacccaaatctcaacttgaattgtatctcccagaattcccatgtaatgtgggagggacccaggggaaggtaattgaatcatgggagttgctggtctttcccatgctattctcgtaatagtgaatgagtctcacaagatctaatggtttatcaggggtttccgcttttgctttttcctcattctctcttgccaccaccatgtaagaaatgccttttgccctccaccatgattgtgagaccttccccagccatgtggaactataagttcaattaaacctctttctttcgtaaattgcccagtctcggactaccaaaaaaaataaaataaataaatagaagactaaaacctaaggccacaaagtttatagtggttatctctgggtagtggaattatgaacaatttttcatttttgcttcactgcattttttaaactttctaaaatgaacatgctttgtttttgtcattagaaaaaagctaatttctttgaaaaaatagctattccctttcagatggcttaagacaacaggatactctaaaactaaggatagagagccctagtttacaacaggagtttccaagtggcccagaaatcagtaggatgcaactgatggtccaagatataaagcccaacaggtgtcttgtaatgatgttttttaaaatgacaatacccatgctcactctcattagtgtggggtcaactatttactgaaaataacaggcggggcatggtggttcacaaatgtaatcccagcactttgaaaggcaaaggtgggaggactgtttgaacccaggagttacagactagcttgggcaacatagtaaaaccccatctctacaaaaataaaaataaaaaaataagctgggtgtggtgttacacacctgtggtcccagctacttaggaggctgaggtgggaggatcacttaagccctagaggttgaggctgcagtgagctaagactgaaccactgcactccagcctgggtgacagagtaagaccctgtttcaaataaaaaaataaaaataacacatcctctcaatggtgtttcataaaaggaggaactagtcactccagtccaaggagttttacccctctgctaatccagctctagagacaaacaggaagagattattgatgagatctttcaccaccaaagtggtctgtatacttgaaacatctaaaaactaccttggaggacagacggttataaatgtgacaatgtcacagacgagagagtggagagaaaagaactttgtgtgctttattcttcaaaccaaggaaactcaccagctagaacaaccctagttgacagaaagtagaagggaggcagagaaagagagaagctagaagtaataggacagaattctatgggaaggggggctgtctcgccatattgacagtgccagtcatgatgtcctgtatccagggtactcataaatatgactgtgtaggaacaggatcacgcccagctaagctgtgacaccagcagtggcaagcacacatctgctgagccacagactctaaactcagaaccaggtcactctgggatagggcagtggcagtagtaggaaaggtgctgttctggagcccaacagctagggtgggctagggattgattctttgattgggtcaaaaatctgaatgattttttggtgggaaactggccaagagagggaaaacactgaaaataactttttaacttaacctggttctctacggattgaaagcaggcgagagaagaggcccatgtgtctgttactagaggatggaggctaatgctccaactccatccattcctatagcatggtgaaaacaaacacatgactttctcctgtctctcccagaggagacacaaggagtgaaatcaacacagccatctcttgccctaattgcctgaggttaataattgcttgtctgaaactgactgtttatgaggcccaagagagaaaaagaggctcacagcctagccaaatggacttgtgagttttagaatacttgctcctaggatcaggaagaagcagtcttccttccatagactgaagtagtctttgggaaggaaaaatctgttcctcctgctattctttgtcagtaactggcatcaacatctagccagataccctggcaacccttcacccttcagctcccatgttcttccttccaccagtcaccaagccctgtggatccacccctggagcatttatcctttcagttcttgctcttgtcatctctctccagcagcttttccccctcctccttagcggtctcccaaccacctcccatccaagtccatctacagaagcaccaaaggaaccttctaaaacagtttagattgtggctagccagtctttaaagacttctgatggttccatttcatctatcaggttaagtctaaactccaacagcaaacaagacccttcaccactgggtctcatttctccagtttcacctctcaccactcttccacacacgccctgtcctccagctacactggactattcccaatttctgaaaacatcatgctgtttcattcttctgtgtctgttcttaggctattccttctgcccaagccatccttctctgcccgctttctagtagaaagcattcgtttgatagccaggtgaaaggtcactttgtctatgagcccaagcaaaggtggtaacaaccgttgattatagttgacatttatggatcacttgctaggtgccaggcactgtactgtatcctctgcatcaagaacagttcctgacttggacaggcgcggtggctcatgcctgtaatcccagcactttgggaggctgaggcgggcggatcacgaggtcgggagatcgagaccatcctgactaacacggtgaaaccctgtttctactaaaaatacaaaaaattagccgggcatggtggtgggagcctatagtcccagctactcgggaggctgaggcaggagaatggcgtgaacccgggaggcagagcttgcagtgagccgagatcgcgccactgcacgcgacacagcaagactccacctaaaaaaaaacaaaaaaaaaacaaaaaaaaaaaaacaaaaaaaacagttcctgactcaaaaaggtcctcaggaaacatcacaacagccctgtgaaagctctatttctgcttcttagaacagctttactgagataaaaaccacacattctacccattttacaggtcaagaaatcaagacagaaacagaaagcttcagtaatgtgaccaaaaccacatagctgactccggtacccactcttaatccctgtgttaataagcctaatactgatgctatcttataataatctgcatatgtttctctctctccccatttctctgtgagtttctcaagggcaacacatttatcttaactttggctctccagcacctagtacagttcctggcacatgtgataaatgaacaaatgaagaaatgaatgaatgaatatcattcagcaatacatatgaaatcctttttaaaaatatgagaatattaaaggaaaccaatgttcttgaggaagaaaaacttatgaagtgtaatacacagagtcatgaacacaggcaaagcacaaaataaatctaactcaaataaagcagagcctgaagaatagtggttgagggtttgttgtggcagagggctggcacagagaatgctctctgtggagtaaactattgcatggctgaggcctgcagtctgggggcagaaacacagtgctgcaacagtcagtaggttggtgtgtgggaagtctgagtgtgggatgctgggacaggtgtggacagggcggacgcacagccggagcaaaagtgagggtgagtatggaggcaggcaggagactcagaaagggctatgtgttttgaaaaaagcttgaaggggtaaaaaggagttaggaaggcagaggaggaatgatatgtgcttggggcagagtcagagaagatcaaggaaagtgagaagtgacttcaaatattttaaacaaactgtgcaataagcaaacatttctggagtttgctctatacgaagagtgtgatgggtgccaggaaacctggtgactcagatagtctctgtcctcagggagctcccagtaaacaattacaaaatacaggaggaaagtacaaaggaagcagacctagcccatcaggggaagctgacacctgagttttgaacaatgagtaggtgaggctgggcagtccaaggctgtgcacaggttggagggcaagagagaatggtgtgctggggtggggctgtgtgtactgtaattagctcaatatagccaaaacagggcaagagctgggaggagtgacaggaaagagaacacaaaaggggctcccgtggatgctggtaccactcttccttaatctgggtgctggttactcaacgtttcgtgaaaattcacgtatctgtacactaatgagttatacatttttccgtatatatgtcatacttcaataaaaagttacaatccggctgggcgtggtggctcacccctgtaatctcagcactttgggaggccgaggagggtggatcacaaggtcaggagttcgagaccagcctggccaatatggtgaagccccatctctactaaaaatacaaaaattagccggatgtggtggcgggcgcatgtagtcccagctattcgggaggctgaggcaggagaatctcttgaacctgagaggtggaggttgcagtgagccgagatcacgccactgcactccagcctgggagacacagcaagagtccgtctcaaaaaaaacaaaaacaaaaaaaaagttacaatccaaaaagtctcagcaagcaggtaggagtcagatcacggagggctaagcttgcacagtcatccaaaaacatctacctacaggcccagacaggatacctgaaatcatgtctgaaatggcagcctcatgtgggcaagagctagggcatcacgctggcctaaccagaaggaactgtgccaagaggactaagagttttaccccaaaatgatataacctaccatttgctagggcagcccagatgcacaggcactaggctttctatataagccttgatatttagccttatcctagggatattagagtaaatcagtcaaatgtgtatgtacattggctgtagtatcaggaaatttcattatctactcaatctagctttgaatatgttatgttttctaactctctatttgtgtcagggtgggggccaaaagcctcagcaagaccgggggtaatactttgcctccagggactgcacctcacagcgatctgggcctgggtgggtggcacagctacaggagtgagcaggaatgtaatgaggtggggccatggggactggttcaggacagggacttcaagtggagtaatcagagaataaagagattgggtcacaggtgatgatctataccaagacaggcagaaacgcactggaatgtagtcaaaagggctcaggtcccacaggactatcagaaaaggaagttgcaccagggtgtggggcaacaagtgagactgcccaggaggaggaggagatcctgggggcagggccaatgtattacattccttgccaagtgtgttcttttaacggggcagcctctctcagagcaatccgtacatatcagtgataacgatgataatttattgagcacttactctgttccagccatgactgtaagcactttacttgccttaagccatttagtcttctcaataattccatgaagtgggtacaattactgtccccattttacagataatgaaactgaaagacagagaagttatttgtctggggtcacgaaactagtgaatgagagcaataggatttaaaccaaatggttttacttcagaccccatgttctgactgcatcactgggccaccctcttgatctcaatcaagcaccataaaaataacaataggcagagcaactagttattgagtggattctgctaaggaagcacgctaagcattttatatttcttatttattcctccactatctctaggaggtagatattctgggatcaaactgaggctcttgaggctgcatgatttgctcaaggctacagagctggtaattagaataagcaggctttgaagttgggttgacctgacaaaaactgagtccttgagtcctctatgactccttccattggcagggctttggcctacaggaacctcaactcgaagtgatgggatcaccaggcctcaggatcatcactcttccattgttcctctaaggctaggctccaggaagagaacctcattgaaacctcccaggtctccctataaggcctataaggatgctaacaatcatgaggtctcttttattttttaattttttttacatggtctcactctgttgcctagattggagctcagtgacgcggtcatagttcactacactcaaactcctgggctcgagtgatctgagggatcttttaaaagggaggatactattaaaaatagcaaccaataccatctgagcagttattacacgcctccataccattcattctttatattcactctataaggcagacactctttcatccccatgctgcagataaggaaactgaggcttagaattgttaagtgacttgcccaaggtgatagagccaggagacagtggagctgggattagccaccagatctgtctaacatgagagcagcctgggctcttaatcatgcttgaataccttctgatagcactgatccttctttctccttggcaagcaagtcctgtcacatggccttttttggtggcataaggaaagctggaagaacccttaggtggcaaacttcaagaatatctcgctgttgacaaacaccaatggtgaaaaagcaggaccatctattagcatctgtttgtctgttttcctttttaaagcctaatgaagactacttcccaaggaaggagtttttaattagctcactgaaaggcagagtacactttgcccaagcaacagccttcaaagcgaaacttaagctgctccactaaactaatatcaacctgcccaaagacctgtgttccccagccaacactacaataaggacatcacaatacaatggcccgaggcttgtcctggcctgcatctctcagagtgtcccaggcaaccctgggctgccacaaaggaagccaggggaaagcaagcagcaagagtcaaggggacaaagcaaacaaggtcactcccttctgtggtgtatctgctccatggaagtctggggagcattgctaagtttacttccactgcccctatcgtcttatcaatcaagttaatttaatttcgtttttaattatgtactcactgaagaaactttggaaaaaaaacatatgaggccgggcgtggtggctcacgcatgtaatcccagcactttgggaggccaaggcgggtggatcacctgaggtcaggagtacaagaccagcctgaccaacatggagaaaccccgtctctactaaaaatgcaaaattcggatgtggtggcgcatgcctgtaatcccagctattcgggaaactgaggcaggagaatcacctgaacccgggaggcagaggttgtggtgagccgagattgtgccattgcactccagcctggggaacaagagcaaaactccatctcaaaaaaaaaaaaaacaaaaaaaaaaaaactacatatctatacgaaaaggaaataaaactcacccatgaacttaatctacaggaacaagtattatccttttgggatctattttctaactatttttgttgctttaacatagttgagattcattaaaatgctgggcacagtggctcacacctgtaagcccagcactttggaaggctgaggcaggtggattgcttgaggcttagagttcaagactagcctggacaacagagcaagatatggtctttacaaaaaacctttaaaattccgagattgcaccactgcactccagcctggacaacagaacaagactctgtctcaaaaaaaaaaaaaaagaaagaaagaaggaaaaaaagaaagaaaaaaacccaactaggcatggtggtgcatgcctgtcgtctcagctacatgggaggatggggtgggaggatcacttgagcctaggagtgtgaagttacagtgagctatgactgtgccactgcacttcagcctgagtggcctgggtgacagagtaagaccctgtctccaaaaaacaaaattagattaaaaaaaatacatatatataatatatatatatatatacacacatacacaattttacattgtttaaaaaaacatttattttcatgtagtttaaaattatatttaaatatcatgtgcataatattctactacatgggtaaaccatattttacttaaccactcctctctaaagtattttctaatttttccagtgattataaataattctgcgattaataactttgtaccataaagctttctgtctttatttctgcattactttaggataggttctcaaaagtagaataaaaatcaaaactacaaacattttatccccaggtggatagtgttagaaaaataaatgaataaaattttttaaaactccaaacttttttttttttttttgagacggagctccgcttttgttgcccaggctggagtgcaatggcgtgatctcggctcactgcaacctccacctcccgggttcaagcgattctcctgcctcagcctcccgagtagttgggattacaggtgcccaccaccacgccctgctaatttttgtatttttagtagagacagggtctcaccatgttggccaggctagtcatgaactcctgacctcgggtgatccacctgcctcggcatcccaaagtgctgggaattacaggcgtgagccaccgcgcctggccaaaaaaactccaaacattttaagactgcccatggttgtacaaatttatcagccaacttccatgtgggagaatatctatttgatagaacatttgccagaactgagaattagcttctaaaatctttaccaatttcagaggcaaaaaacaaaaaaagctttcaaaagtttttaaatttcaatttgccttttctttattaattatccatgagttgaatatttttccataattttcagtgatttatattccttttcttgtgaattttctcaaatattttcttttttaggataaaaagtaaattattccttaattttattaaataattttattaatattatgtggtaaaatgtgaactgtagaaatataacttgcagaagttataactgaactaactatattatatatactgttagcagagattactaaaatactcaaagagctggagtggttcagagacctagctaaaatagaactcttcaaatattttaacagattagaaatgttgtttgtgagggtctctatttatagtagcaaataatggaaaacaaatgtccaacaaaagagaagcgctgggatctcataacaaatacgcaagaggaactgaagtggacatgcagcagagtgatgaaagacttcctttccaatttataggtttgaatttcttttattcttaccaaatgcttaaactacttgcaaaattaaatttaaatttaaaggaaatgacaaatatgtgaccaatgtcagacatgattcatatgaaataagtgataaaagtaaaacaaaattatgtatataacattacgaaaatgtctatgaattcattaaacaaaagtctggagtgatataaaattttttttgctctgtggaacaaaaaaaaaaccatggctgtgaaagagatacatataacttacttacatgtttttcttccccaaacaaaaaccttttcgttgacttacaggtcataaaatatttttttttaatggcatacttttacatttttacgagcgactcctaggaaaacaaataaacatgcaccttctgagggcatgtcttcagtttctctatctttgcactcggctattttaaagatgacatttccaaaggccagtacttggtcccttctgccaggctgctgcgtatattgtttattttaatggacaccagacaccttgataaatgacaacctatctgaacctgacactctggaaacagggattaaggcagggagagttcacagacagcagagtatttactgttaagagttatttctgacaaaatgaccaccacgatcttcagaacaagacaattcaggctatgcaatatctagccattttaagtaatccaataataaattaaactaataggcctacagaaagaccactcataagcattccaagagaaacaatctcttataaagacctaaggcatcctcgggtgccaccccagaaaaggtaggcaaactgtaagtaaaaggttctatgtacaactttttactctttacttcctgagtacacaaactatttaacaatagtgtacaaatataaggactcttacacgcttcttatgggagtataaatgtggcaatacattccagaaatctgactgggtgtggtggttcatgcctgtaatatcagcactcaaggaggtagaggtgggaggacagcttgagcccaggagttcaagaccagcctgggcaacacagtgagaccccattatccacaaaaaggaaaaaaaatcaataaattaattccagaaattgttaaaaagtggcaaatatttctatttctaggacattataagaaaataactaaatatgagtgcaaaaattgctgtacattagaaagttaattgtaatatttaaacagctaaaaactggaaaatcacctaaatatttaatgatacatacattggttaaagaatttctatattcataaaatgaatatgcagccattaaaaatgatagactagaactgggcgcagtggctcacacctgtaaccccagcactttgggaggccaaggcaggcagatcacttgaggtcaggagttcaagaccagcctgaccaacatggtgaaatcttgtctctgctaaaaatgcaaaaattagccgggcatggtggtgcgtgcctgtagtcccagctacttgagaagttgaggcacaagaatcacttgaacccaggaggcagaggttgcaatgaactgagatcatgtcactgcactccaacctgggcgacagagcgagactgtctcaaaaaacaagatagatcagacatttattgatatatgttatatgtagtaggttgtattattggccccaatttccccccaccatgtccaggccctttgctgtataactttgccgtgccttcctgttgtgaacaggatggaaatctccacccctgggctcagccatgtgtaacttttttttttttttttgagatggactctcgctctgtcgcccaggctggattgcagtggcacagtctcagctcactgaaacctctgcctcccaggttcaagcaattctctgcctcagcctcccaagtagctaggattacgggtgcctgtcaccacgcccagctaatttttgtatttttagtagaaatgaggtttcaccatcttggctaggctagtcttgaacttctgacctcatgacctcatgatccacccacctaagcctcccaaagtgctgggattacaggcgtgagccaccatgccgggccatatgttacattttgatcaatgggatattagcacatgtgatgcaaccaggaacttaaaaagtgcatgcctgactaggcttgctcactattgtgcttctgccattgctatgaaaagaaaatacctaagtctgtcccctggcccaagaggatgacaaccatgtggagcagagcccaacctagattagccaactccagccagccactgacgtgaaaatgaagcccatgtaaccagccaactgacaagccatgtccaacctagatcagctgactccttgctgacttacagatgtatgatctaagtaaacacttgttgttgttttaagctactgaattctggaatggtttattaacatttttgtggtactagctaattgatacaagatttaaaagtctggagggaaaaatgttggaaaaatctggaaatatataacccaaatgcttacagaggaacttttagttaaaaataatagattgatcacatgtgtttatcaactctccctccaaaaatctcattaaaatgaaaacaagagattaaaaccatattaaatcacaaagaaaataaggggagattatagcaaaaccaactttaacacaatagtgaaaaaatacaaagcaggtgagagaagaataaatcacttggtgatgtggaagaaattacagctcagtggcctacaaagaggattactaataaaaatcagccaactcaccccacagaacttctgagaaattcagcactagagtgcatcaggtgctatgggaggtgggggtatggcatagagaaaaaaatcaagttgaaagtttatatacagaccactgagaacaacaggtgttaccccaactatgtgcagccaaatgaccattcccgcataacccatccctctaactttctactctacctgcagaagacctcagttctggagaaagctaactaagggcacaagtctaggaactactttgcacagtagtgggctgaggagaggtgtgggctgaaaagcaatgagattaaataaagtctccagactgaaaccagccaccttccctgttcctgctctcacaactccagcagctagtcttatgcaccctccaccccacaaaaaaaccctaactctgctaccccagacaggacttcagaggattcctctttgggaaaactgaatagttgcaaaggaaaataaaacctgcagatgatgacatttgtaaatgcccccgacccaaagaaagaggccagcccactgcctgattccctgtacagtgaaaatgatccaccaacaagccctgcccatgcacggagtctccagtcaatatgttagtgcttcatttaaaatttttttttattattattattttttttacagatggctgtcacccaagctggagtacagtggcacaatcatagctcactgcagcctcaaactcctagactcaagcaatccttctgcctcagcctcctgagtagctgggactataggcaagtaccatcacaccgggctaaattcctttttttgtagagacgaggtctcactatgttgtccaggctggtcttgaactcctggcctcaagcaatcctcccacctcagcctcccaaaatgctgggattatgggtgtgagtcattgtgccaggccatgtctcactcttaaatagaaacagcaaggattaccatacatataagaaaatcatatggaagaaatcctcccaaaacaaacaattaaaaaaaaataccaggaagacaaagagactatgcttggaacaaatagaaactgaaaatatatatgtataatcagagatgtaataaaggatactgtggtgataaaataaaaataggatgcctcaaagaaacaaccagagaccagataaaaatgtataaaaatgtaataaataaaagttaaaactcaatagaggagctggaagataaaaacaaggaaatgtcccagaaaaagtaagagaaagtaagtaaaaatgatgggaaaaacaatagaaaataaaatatgcataacttaatcaatcaagaaaatccaacatccaataaacatccaaaacaagaggacagagaaaacagaggtagaatttggaaaagttgttcaggaacaccctctagaactaaagacactagtttccatattgaaagggcctaccaagtgctcagcataatgaatttaaaaagacgcatgtccagacatagcatcataaaatttcaaaacgctcaggataaaaagaagacacttaatttttcttctcctttttttttttttgagacagagtcttgctctgttgcccaggttggagtgcagtggcgcgatctcgactcactgcaagctccgcctcctgggttcatgccattctcctgcctcagccttctgagtagctgggactacaggtgccagccaccatgtccggctaaccatatatatatatatatatatatatatatatatatatatatatatatatatatatatatatatatttttttttttttttttttttttttttttttagtagagacggggtttcaccgtgttttcttctccttttcttgaggcagggtcttgctctgttgcccaggctacagtgcagtgtcactatcttggctcaatgtagccttaacctcctgggctcaagtgaccctcctgcctcagccacccaagtagctaggactataggcacgtgccaccacacctggctaattttgcttattttttgtaaagatgaggtctcactacgttgcccaggctggtctcaaattcctaggctcaagagatcctcctgcttcagcctcccaaagtgctaggattacaggcttgagccactgtgcctggccagaagatattaaatatttcaggaaaaaaaaactgggttatatccatgaccataaaactgctcaatagctaccaagatactagaagacaatgaagcaatgccttcaaaattctaaaggaaaagttattcgagtctaaaattcttaatcctacccaactattaatttggtgctaaaccagaacaaagatattttttagacatggaataactcaaaatatatatctcatatacccttttttttttttttgagacggagtctcactctgtcgcccatgctggagtgcagtggcacaatcttggctcactgcaacctctgcctcccaggttcaagcaattctctgcctcagcctcccaagtagctgggattacaggtgcccaccaccacgcccagctaattttttgtttttagtagagatggggtttcaccatcttgaccaggctggtcttgaactcctgacctcgtgatctacctgccttggcctcccaaagtgctgggattacaggtgtaagccactgcgcccagccttcatacaccctttcttagacaactactgagaaagtacttcagaaaaacagaaaaaaatcaataaaaaagagaaggaactccaggagaggagggatacagaacaggagatttatgaagttaagttccagtatgacagctttataccaggcccagagaacaaccaggacagactggggtaggataaaagatgtgtgagaaaaatctccagaaaaacaataaaacctataaactatttgatgtgtttaagtgttgttaaaagaaaaaaaaaaaaagaacattgttaggtacttgacagatctagtggagcaaccagggaataaaacagtgattggcacccacaaactaagcaaaaaaccaaacaagcaataaaagacaattattaaccccaggaaaaataaaaggtagtacatggaagaaaaaagtagtcatagttactactttgcccagcagtggaataacacacacagtgttgtaaaatataggtgctgatactgattcaataaaaactatgatgttgaccaggtgtggtggttcatgcttatagtcctggcactttgggaggccaaggagggtggatcgcttaagtccaggaattcgacagcagcctgggcaacatggcaaaaccctgtctctataaaaaatacaaaaattagccaggcatgatggagggtgcttgtagtcctagctacttaggaggctgaagtgggaggatcacctgagctggggaggtcaaggcttccgtgagccatgactgccactgcactctagccctgagtgacagagtgagaccccgtctcaaaaacaaaacaagaaaaaacaaaacaaataaacaagaaaccatggtgtaactactacaggaaaatcaggcaaaggggaaaaggggatattggtaccaaagagctaaatttttttttttttttgagatggagtcttgctctgtcacccaggctggaatgcagtggcgagatctcggctcactgcaacctccacctacctggctcaaaccattcccctgcctcagcctcctgagtagctgggattacaggtgcacaccaccacacccggctaatttttttcctatttttagtagcgatggggtttcaccatgttggcaagactggtcaaactcctgatctcaggcaatccaaccgccttggcctccaagtgctgggattataggagtgagccactgcacctggccccaaagagctaaatctttatcactgtccatgatgggagtgcaacaaataatgtctaaaatttataattcaggaaatataatataaggtcttatttagaaatatggaatactagcaaaagccagaaagtagttgcttcaaagaagttgaactaggggtgggaagaaagaggaaggctgctattctaatcataagccttttagaaccttttttaattttttttaagagataaggtcttactctgtcacccaggctggagtgcagtggcatgatcacagctcactgcagcctcaaacttgcaagctcaagcaatcctcctgcctcagcctcccaagtagttgggactacaggtacatgccactgtgccaggctaatttttttatgttttgcagagacaagctcttgctatgttccccaggctggtcttaatcttctgggctcaagtgatcttcctgcctcagcttcccaaagtgctgagattacaggtatgagccaccacacctggcctagaacttttttgtaaagctatgttaacagtcactgtctgagaagttaagttttcaagatgttttaatttttttctcttgccatgactacattttctaaataatcttgtattacttgtgtaatttttaaaaatgtttttaagtgttgcattaaaaaaaaaacaaaacaaaaccacagcacaagtgttgcaaaatcttgcataaatcagggactgacctttgtactctcctttcagggccttaccttttatcgtagtcaaaatgaagaaagcaatgagggtgttgttgatggcacaggtagacttggcaacacaagacaaaatcgtgtaaggatttaagagatagctggggaagaacaaacatatttggcattagtaatcctgaccaaggagccctcgccattacagcaaggaagttccaagagatttattaaaagcttacgcaaaggaaggcagcttctcagaaatgagttcccccaaataaaagagaatagagtgggggttgaggctgataagtaaaaggtactgaacatggactgcctattctgttctatggagtatatggaaaactgttgtatttaatcatcacagagatcctgtaactcacaataacatcattccagttttgcagatgaggaaacatttgcaggtgacattcaagaagcagctgagtctcaatggtaaagcgacttgcccaaaatctcacaaactaataaatacatccaaaatcaggtctttctagctctataaatgttcattttactatttcagatttcaaaaaatgataaaattctaccaattcccacagagccacatatctcaagaatagctacatttacctctgagaaccaggaaagtacattttcctcagtcaggctcctaagccctgacacaggtcatgccaatccaagagttaaagcagcttagatgtagccttcttggcagttaaacagaatccactgagccagaccccaaggacagaataagtatctactgagctcaacaagtcaagtgttacagaacttcaaaggacatctggaccctcactaggaaggagttaataagctgaaacacctagtgttttcctgagatgggaaggaatgaactgagaaaatgaattcaaaatgtttgtgagtagggaaatcttagatagtcataacaaattgtttgtatttatttctatcctgcttccacaaaggatttgaggcagctaaaatgagaacaagccgggagcagtggctcatgcctgtaatcccagcactttgggaggccgacacaggcagatcacctgaggttgggagtttgagaccagcctgaccaacatggagaaaccctgcctctactaaaaatacaaaattggccaggcgtggtggcacatgcctgtaatcccagctactcgggagcctgaggcaggagaatggcttgaacccgggaggctgaggttgcagtgaaccgagatgacgccattgcactccagcctgggcaacaagagtgaagctcagtctcaaaaaaaaaaaagaacagataataaaaaataggctgggcatggtggctcactcacacctgtaatcccagcactttgggaggccaaggtgggtggatcacttgagctcgagttcgagaccagcctagccaacatggcgagactctgtctctactaaaaaaaaaacataaaaaaacccttagccaggcatggtagtacacacctgtagtcccagatacttgggaggctgaggtgggagaatcacttcagtccaggaggtagaggctacagtgagccgtgactgtaccactgtactccagcctgggtgacagagtgagactccatctcaaaaaaacaaagaacagataataaaaaataatagcaaagtacaaatagaaataaagaatcggccaggagcaataactcatgcctgtaatcccagcactttgggaggccgaggtgggtggatcatttgaggtcaggagttcaagaccagcctggccaacatggtgaaaccccgtctctgctaaaagtacaaaaaaatatccaggcgtggtggcgggtacctgtagtcccagctactcgggaggctgaggcaggagaattgcttgaacccaggaggtagaggttgcagtgagccgagattgcaccactgcactccagcctgggcaacagagcaagactccgtctcaaataaataaataaataatcaagagcaaggaaaacataaataaaaggagacagtaaaggcaatggaaggaccaccaaatggatattctacagcactatagtaatcagctacaaattcggctctgagtttcctggcagagaaagtgaaaaggtagactagttacataattctggttatcagataggaagaaacatgccagtgtctcaggaagagatgatgattactattcacaaataaagaccttaaatccaatacctcccacgactgtgagattagcagttctacagccaaaggcctagaaattgctggcggtttttttcagcaattacagacaggcttgttacataatctttaaagaaacagctgctgctattacaaagctacccccaggacacacataagtccataagagattcataaagttgctaaatttctggttctattaaggtagatcccaccaatatttctgaaatacatagattagaactgatagtccaaaactatttggtgggaagaaaaaaaagccatttctaaatagcaggtgacgttcaagaagcagctgcatagacatctaatagggaataggaaatccacacacaaggcagaaggttgagtaaactagtctcacaaggccccttctaattctgaagttctaagggcgtgtttttccacgaggaaacttgtttgtcttgtttactgtatatccctagaaactggtatattattaatattcaatgactattagtggattgaataattattcacatttgcctatctcaggaagataaatgggaataacccaaaagagtacaacttaatggtagcactgggtacaccctagagaattctttcatagagcctcagtaagttccagtcttccacatgggtcacccagctggaatgcatctgtttggcacttcagttttataagctacaaatggaggactatactgtacacgaaacataagagctgcttgaaatggcagccacataaaaaccaaacttttattcaatccatacatcacaattgaagaactttagaaacactggttataagtaggctggaacccagatcagcatggagtcaaaaagcatttgtgaagggtttgattgtacacagccctgtgtgagtctttgtcccaagagagacagaatggctctgtctcttttgctggccagaacaacagagcccagttgtgcaacagaactacagcaaatacttgatgactaagattgcaaatctccaaaaatacaacaaacaacatgggaaagtctcatcagattttcctcgcatttgttggcactaagcctgttttgtcagggaatacttacaacagggccactttcaaagggatgtaacgcatttccataggggtccggatgagttcggccacatctggggcatactggtccagttctaggaggagtttctgctttttaaactagaaaaaaaaaaaaaaggaaaagataaaacacatgaaacaattcacttcccattgtttttatgctgaagacaaaagtcctttccatggcccacatggccctgcctggtctggccctacctctccaggctcatctcacactcggccctccccatcccctttctgggttccagcaccatgaacatgctgtgtccctccttttcccacacctttgcatttgacctggaataatttcttcttctctttccctagttaactcccacatggtccttatatctcagttaaatcatcatttccttaggaaggcacactttccctcaccaccccacacccaggtaaaatccccctgttatatatgttctttcacatatgttcacagttagtaactttttcacttatttatatgattgactaatgtctgtctccctcattagactaagagttccatgagggcagggaccatgtttatttgcttaccatgtatgcctaacacctggcacagtggacaaacaataaatatctgttgaatggctaaatgaatgacttgctggcaaagcaaagttcatagccatttgaagagttatcatcagtggcctaaagactccaaagttccatccatgaagaagtattgtcaagcaaggtagaatgatcccaaatgtcacaggatcttgggttatgttttacttccacagaggaggcgtagaatggccatgatgatcaagaggaggaaagctgggtgtgggtgggcagctggatagttaatagggagtgggatgggggtggaaagctcttgccttccgctggtgtgtcctaacaagttcatgggtgtgttccagagtgaaagaaaggtaggcaatcttataagcaaacatgggtcagaatatagatgagaaagcctctcaaaccaaaatcggtggccctgttgatttaatgatcaaagaatctcatttagacaatataaaatcaatgctgctatctattagaaaacagtatttcagaggagccaagatagctgtgcttaactgtgaaggattaaaaatttaatgatgtaaaaagcagatcacactagaaaatatactgcattgtgacatttatatgaagttaaaagcatgtaaaataatactatgtgttgggggccaggcatggtggctcatgcctgtaatcccagcactttgggaggccgaggcaggcagatcacaaggtcaggagatcgagaccatcctggctaacatggtgaaaccccgtctctactaaaaatacaaaaaactagctgggcatggtggcgggcacctgtagtcccagctactcgggaggctgaggcaggagaatggcgtgaacccgggaggcggagcttgcagtgagccgagattataccaccgcactccagcctgggcgacagagcaagactccgtctcaaaaaaaataaaaaataatactatgtgttatttagtaacatatataataaaagtcaaggccatgtgtgtggatgataaccactagattcagaacagtggtactgggtaggaggagaaatagggagatgaaagtatgagagagagagagagagctgtaggagtaaatttttttcagcccgaaaataggttcaaaagtatgtactatgctttatctatttttgcatgtcttaggtctttcaaaattaaaaaaaaattaaccaaaaaatatttttagaagaccatctttcagtttaaacttgcacaggtttaggtagaggcttaatctgaaaacctgcaacaaacttcaaaaacctccctttgatcatctctgttcttctcacagttggcagagtccaagttaagcggtgggaattatcagtaagatttatggtgccattcacagctggggttgtttaattaaaaggacaaaatataaaccaaggtgcttttatcacagagaagggggctggctcagcaatcaagtgcttagtgaggacagctgcagcagtggtagcaggaaggaggcctcactagctaagaggtctagagttctgcagcaaaaacaaggccacctggagtgggtgagatccacaaagaaggctgtgagaaaggaatagagttcatccaggggcagccagacagacaggtgggaatgcagacctcattccccaggctggaagccagccagcagggctgcactgagagaaagtggcaactacccgggatgtgtacatcctgggcaaaggtgacactgtgccagcaatggaagtacttccttataaccacaatcttctcaaatactttaaaacagaaagatcttctgaaaggagtctccaggtgggaaggcacacagatcagcaatccccacattctcagctttctagtctccctcaatttcagcagcacaggcactattatggctctcctcataggcccaatatcagctctcctaagtgtagacaaaatcccttttaaaaatccctattgcatccagctagagacaggaaagtggctaaaatcaatggaaatttttaaaattatacacacatgtgcgcacgcgcacacacacacacacacacacacacacacacacacaccccttaagaaaatataagtataaaatgaagttagggtatatattaaaatctgatgatcaatatttctagatacattcattagtcttgacaatgataagatttaaaacaatgacaggagagattaaaagtgatgtgaagggtagtgacctggatatcttacctttgtgatcactaatcagcttgtagacagatggtatgcttttccatatgtaagttatattaaaaaatcaaaatgttttaatttttaaaaatctccagggtagagtcttcctttccttccacccactcctctatacagccctttccttgtcccttgaaagataggttttgccaggacataattcccctacttcaaataaagggctttattttcttggagacagagtcttgctctgtcaccaggatggagtgcagtgttgcgatctcagctcaatgcaacctccgcctcccgggttcaagtgattctcttgcctcagcctcccaagtagctgggattacaggcgcccaccaccgcgcccggctaatttttatatttttagtagagacgggctttcaccacgttgaaactcctgaccaggctggagtttcaccaggctggtcttgaactcctgacctcgtgatctgcctgcctcagcctcccaaagtgttgggattacaggcgtgagccacagcgcccggctataaagggctttttctaatcattgaagctgcatctacgttcatttgcatccccaaaaactatggtggggtcggggagaggaaacactccacccctgtccctactcctctccaactgttagcctcagcacattccaaattcaggagcctagcctccaaatttacaaccctctaatcatattaaggggacacaggtttttatcatccattatcaaaccacctgcagctctcttaacataaattctgagttccaaacaagaagcaccatctcagcaaaggacagactagactaacattgtttttgtcaagtgagatagatgtaaaatgtcatgataaccaactggtcaccatcagcattcagtccgcaggctaacagctggagagggggtgggggtgcagtcccctctctgccctatagttctcccagatgcatctgtgtgtagacatagtttcattaccaaggataaaaagactcaaatcccaccaagatttaaatacttcccagactatgcgatatgaacccttctgacaaagggaagaagatttagaggaagacatgctgctatcctacctaaatcaacagtagtatgttagtatcatcaaaatctgccatttaaaatgagttaatttttgacagagcatacataaaacttctattctgatgaagaaacctaatgttctaatagtctgaactctaaaagtggaaaaacaaaaacattccaaattttacttcagtcttggtaataacagaatgtcttggtgcactaaaaaccagggtattgacaacaccgtttggctttctctctccctctttaaatcatgcaaagaaaaaaacccaaaaatctctatatatttccaaataaactcagcaataacaaacaaattattggtgctctaaattaaaggcatctctcctgttgacattgaagcctgactttgttaggcaattaactgaaacctagtttcattgcttcctcataaactaaccctaccattaaaaactgttttgttttgagacagtgtttcactctgtcactcaggcgggagtgcagtggcatgaccacagctcactgcagccttgacctcccatgctcaagccatccacctgtctcagtctccagagtagctgggcctacaggcacataccaccactcctggctaattttttaaagaattttttgtagagacagggtcccactatattgcccaggctggtcttaagcaaaaaattgttttaactagggagtgtgagaggttttttgatgagaattgagcaggaaaaaaaaaatacatatggcattagcatctaatcaactttcattaaaacacagttcagttttacattttggttataaagatctgggtaattgtggtcttagatgaaagctaccaatcctgcctcagctattcatatctatatcacacatatatatatctcatatatatatatatatatatatatgcacacacacatatctcatatatatatatatatatatgcacacacacaagtttattttttccctagtcttttttttttttttttttttggagattcactttcaaaaagtttcactctgttgcccaggctggagtacagtggcgcgatcttggctcactccaatctccaccacctgggttcaattgattcttatgcctcagcctcccaagtaggtgggattacaggtgcacaccatcacacttggctaatttttgtattattggtagagactgtctacctacccaacctatttcggagaagagaacagtcactgctaatttatatctgaattcctcagcttatgaaacccatgcccaattatttcatctacggccctcaagagaatcctgttaaagcatttcatctcagcccctaaagttttcaagatatgctccattagtttaagatatatactccctggtcttggtgatactaagtccctaaaatatagttcttaattttagaggaagagtcaaagaccacacaccaataacagctatgaactcttggaaacaatgatatacacacacacacatataattctccataccatttccacagttttataggcccattaaggccaagttaagaaccctcagtctagatattttttaaaatctctctggggtctaaaattctagaattcaccagcttcatctgtcactgatgaccagtgacacagaaagcacactgctatttctggtttcattagtaacaaaagctaaaatgaaccacaaacagacaatgccaatgagatgcagccttatttcaccccagcctaaatcttctctctcagtggctcccagccaatcaaggagtgttgtagccatttaactacatgggtagtacacatggttaatctgttaactttctcagaccccaggaaaagaagaatggtcccactatgcaattctccttggctattacatatggattaagactgaagtttatatcaggcatttaatacatgtcaaattttccaattaagattactttctgcagggagacagaaatgacattgagaatccaattttacctcagataggcataacagtgacttaaaagctgtatttatcttcctatgcaaaaaaaaaaaaaaaaaaaaaagactggtgaaagactagaagatttttaagggtcctcattaacgacaggtaatataactgttattcagcactactccagaagtctgaacttgcacaggtatgtggatattaatagttattaataagctacatagatgaagctggcccttctttatctgttagtaaagctgtcttgtgggtttggggttgatcattccagagctggctgaacaggccagaagtttcaccatcacttcctagcactttaaagcatctggatccttaagtataagatctttgtaataacaaagaccagaaggttaccaaattccaccagctttgctccacccacaaactacttaccacaactttattgaagtcctggattgcaaaatacagggcaatagcagtgagtgcatcagttatctgtcaaaagaaagagaaataataggaaatggaacacagtaagtgtaagagtactagagtgctaccagggcttggagttttgagatagtgatggactaccaagtactggactcttacaatcaggtagaacttcaaccctcactttgactacccaaagataaggcccattcaggcagggtgaactggaaatccctgaggatcaggacccatctaggttcacttcagtttagtggcccatatctgctctagaattgcaagatacttatgttttttgtaaaatggaaataatacccactgctttgcatgcctgatgtatgtcaagtgcctagcacacagtaggtcctcaataaatagagtttgttataattactaaggaagacctcagtgggcttcctgggtatttcttgactcaaattttcaatcccagacaagtgtttcaaattgctatgctctcaaaacatagacctgtcatcccaattctgaagcttctcgcccctgaaagcctcaaacctgtgtcctcttcttccataatgactcacagaatctcttggcaaaatgcttaggacaaattcagaatgccctccacgccggcttcacaattaaagccaatcatagaatctcagagctagaaaattcaagactatatatagtccagaaaccaaattctaaaaagagtaagtatttggaactggttacacatcagaaactattcctcacacttccataatactgccacagttccatgaattcaaagtaaagacataagtttttgcttttattttctgagaaactcctgagttcctatgttttttgttttttgtttttttcttaaacacaagatgacaagccgggcactgtgtcatgtgtccatagtcccagcagctgaggaggctgaaatgggaggaccacttaagtccaggagtccaagaccagcctgggcaacacagtgagaccccatctcaaaaaaaaaaaaaaaagagagagagagacaataaaccataaaatttaaaaatatatacatatcaattttatatggaaggttacttaccataaacaccaattcagcatagtcaattaggaaatgaaagaggtatattattaatggagtctgcagaaaaaaaacagacatgtaaaaaaaattaagttaaaccttactattatcagtttccagagtagagagtggggagaaaactattatgtcagcaaactattatgctagtattctccttcctggaatactgttctacgccagctggccggtgtgcttataggggagaataatttagtactgccggaccattttgtgctgctgggactatctgttgaattgagtaaaggaaataaaatctgatgtgttaaataaccattaaagaatagtcaacacactggccaggtgcggtggctcacgcctgtaatcccagcactttgggaggctgaggcaggcagatcaccaggtcaggagatggagaccatcctggctaacacggtaaaacccccgtctctactaaaaatacaaaaaaattagccgggcgtggtggcgggcgcctgtagtcccaactactagggaggctgaggcagaagaatggcgtgaacccaggaggcagagcttgtagtgagccgagatcacgcgactgcactccagcgtgggcaacagagcgagactctgtctcaaaaaaaataaataaataaataaaaaatatatagtcaagacactaaaggtaagaggtgaattgtagttctaagacatatataatagccgaggggaattccacaacagaccaagattgctgattccatttcactcacaaaatgagcttcttctgttctctgataagtttgtataatatttttttctttatttattttcttgagactagttcagaaagattaatgttatttcttcctcaaagatttgggaaaattcactcactgtgaagccatctctgcctggattttctttgagagattttaaatcacagattctatttatttcatagataaaacattcagatttgctgtttttactttgtcaatttaggtaagttgtgtttttccaggaatttgtccatttcatctaaattttcaagcttactgacaaaattgttcatagtatttcattttttattgtttaaagcaataaagtttcctatgagtatggctttagctgtatcacacgagttttgatacgttggatttttttgagatggagtctcgctctgtcacccaggctggagtgcagtggtacgatcttggctcagagcaacctccgcctcctgggttcaagtgattctcctgcctcagcctcccaagtagctgggattacaggcgcctgccaccacgcccagctaatttttgtatttttagtagagactgggtttcaccatgttggccaggctggtctggaactcctaacctcaagtgatccacctggctcagactcccgaactgctggcattacaggcaggagccactgtgcccagccattttcttcaatatcatttagttgaaaatatattctaacttccagtaacatttcttctttgagactactttaaaatgtaccatgttcaatttccaaatacttaggagttttcttttcttttcttttttttttgagacagactctcgcactgttgccagggctggtgtgcagtggctggatctcgcttgctgcaagatcctccacctccagggttcagatgattctcctgcctcagcctccccagtagctaggattacaggtgcctgccaccacacccagctaattttttttgttatttatatatttattttgaggcagagtttcgctcttgttgctcatgctggagtgcaatggcacgatctcagctcatcgcaacctccgcctcccgggttcaagcgattctcctgcctcagccaccacgctgggctaattttgtatttttagtagagatggggtttctccatgttggtcaggctagtcttgaactctcaacctcaggtgatccacccacctcggcctcccaaagtgctgagattacaagtgtgagccaccgtgcccggccgttttttgtttgtttgagacagagtcttgctctgttgctagagtgcagtggcacaatctcggctcactgtaacctccacctcccgggttcaagcgattctcctgcctcagcctcccaagtagctgggattacagccgcgcgccaccacacctggctaatttttgtatttttagtacagacggggtttcaccatctcggccaggctggtctcaaactcctgactttgtgatccacccgcctcggcctcccaaagtgctgggattacaagcgtgagccaccatgcccggcctaatttttttttgtattttttgtattttttgtatttttagtttcactatgttggccaggctggtctcgatctcctgacctcatgatctgcctgcctcggcctcccattctttttatatttttataatttctttctggcttaactctactgtggtaatagaaaatacactatatgactgcaatcatttaaaatgtgttgtgacttgcttaacggtccattatatggtcaactttggtaagtgctgcaggtacattcaaatatgcatattaacacctatggttgcatcattctatatatgacatgtaggctcagtttgctaatgatttgttcaaatcttctacatccttattgatttttttggtctgtttgttctttcactgactgaaagaggtatgttaaaaatctcccagtcaggcacagtggctcatgcctataatctcagcactttgtggggctgaggtgggaggatcacttaagcctaggcatttgagaacagcctggacaacatagtggaaccctgcctctacaaaatatttaaaaaattagctgggtgaggtagcatgcacctgtaatccaagctacttgggaggctgagttgggagaattgcttgagcccagggagattgaggctgcagtgagccttgtttgtaccaccgcactccagcctgggcaacaaagtgagaccctgtctcaaaaaaaaaaaaaaaaaaaaaatcccccactgtgactgccatttttgctttatatattttggagctatgtaattagatgcagttctatgtagaattactatatcttctgggtgcagtgatctttttatcattataaaataatcctcttcatctctagtaaggtttcttgtcttaaaatattcttgatctgatagtatagttacatcagcctctttgggctgtcagcataatacagttttttctgtcattttactttccacctttctgtgtccttatatgcaaaattttttgtttttgtttttggggttttttcctgaaacaaagtctcactctgtcggccaggcaggagtgcagtggcacgatcatgactcactgaagccttgacctcccagactcaggtgacccccctaccttaccctcctgagtaggtgagactacagatgtgcgccaccacacccagataatttttgtattttttgtagagacagagttttgccatgttgcccaagctggtcttgaactcctgggctcaagcaatccgcctgcctcagcctctcaaagtgttaggattacaggcatgagccactgcacctgacctaagatgtgactgattgattgactgattgactgatttagagatggagtctcactctgtccccaggctggagtgcagtggcgcgatctcagctcactgcaacctccgcctcctgggttcaagtaattctcctgcctcagcctcccgagtagctgggactacaggcacgtgccaccacacccagctaattttttatatttttagtagagatggggtttcactgtcttagccaggatggtctcaaactcctgacctcgtgatccgcccgccttggcctcccgaagtgctgggattacaggtgtgagccaccacgcccggtctgttttattttgaacttatgttcaaaattacatatgtttttctttgaccttctcctacttgggtttatagagcttcctgaataaaaatcttagtaaatgttgaaaaaaatttcatccataatctcctcaaatactgattctgcctcgttctgtctcttctcccattctagaactccactgatgtataatttgggctgttttactaagtttcagatctcttactttttttttttttttctgtgttttctatccttttctctccaagtttgaatctaggtattttcaacagactttatcttccatattactaatcttctctttagctttgtgtaatctgctgctaaattcatctatacatttttttttttttttgagacggagtctcgctctgtcacccaggttgaagtgcagtggcgtgatctcggctcactgcaacttccgcctcccaggttcaagtgcccaggttcaagcgattctcccacctcagcctcccgagtagctgggattacaggcgtatgccaccacgcctgcctaatttttatatttttagtagaaacagggtttcaccatgttggctaggctggtcttgaactcctgaccttaagtgatctgcccaccttggcctcccaaagtgttggtattacaggcatgagccactgtgcccggtccatctattacattcttttttttttttttttttgagacggagtctcactctgtcacccaggctggagtgcagtggcgcgatctcggctcactgcaagctccgcctcccaggttcacgccattctcctgcctcagcctcccaagtagcagggactacaggcgcccgccaccatgcctggctacttttttgtatttttggtagagacagggtttcaccgtgttggccaggatggtctcaatctcttgacctcgtgatccgcccgcctcggcctcccaaagtgctgggattacaggcatgagccaccgtgcctggccttacatttttaatttattatgttttctatttctagaatttccgtttgattcattttttacataccctggtgaaattattctgttatttatttcttgaacatattaatcattgatcatagctatttttcttttttgggaggggggaaagggtctcactttgtcacccaggctggagggcaacggcacaatctcagctcactgcaacctccaactcctgggctcaagcgatccttccacctcagcctcccaagtagctggaactacaggcacacaccaccacacccagctagtttttgtatttttggtagatacagggtttcaccatgttggccaggctggttgaattcctggcctcaagtgatctgcccatcttggccttccaaagtgctgggattacaagcgtgagccactgcatccggctgatcacagctattttaaagtccaagtagtttgataacttcaatatctaaatcacctgtaaatctgtttttattgtctatttttttctgtctcttattatgcttggtaatttttttccttttctttttttctctttttttttttttttttttttttttttttttgagaaggagtctcattctgtcatccagtcgggaatgcggtggcgtgatcttggctcactgcaacctctgtctcccaggatcaagtgattctcctgcctcagcctcccgagtagctgggactacaggcatgcaccaccatgcctggctaatttttgtatttttagtagagacagcgtttcactatgttgcttaggttggttttgaactcctgacctcaggtgatccgccagcctcggcctcccaaagtgctgggattacagatgtgagccaccatgcccagccaatggttggtaattttttattgaatgacagacattgtgtatgacaaactacagcagcttggatgaaggtattttcttctggaaaagatttctttaagctggtaattacaatatagttgtttcactttagggattgagctaatttgaagctggatttagtctttgtaaaactagtctatattggtctacccttactcctagagtgtagtccttcagaagttccagcctaaaggcaagtcctttaccagagccttgtcattttggttggtcctgcactccaatttgtatttccccagcaccctgagactgccaatagctctgcttagcttcttggtctctagccagccaatttctgttctgcttctccacctgtgtcacttacaaattggtaaatgcttcaaggacaaagcagctcagactgttcgtattactttttgtactttcccctctgggatcttaatccctggagtcctgcttatcttggtactttccaatgccttccagcagatgtggttttttttttccttttttcatattcatcctgcttttctagttgttcgtggcaggtaggttggtctgctactgcaagcccgttcaccaatccaccagaaccagaagggaagtgcatgacctggttttagcgagcccatgctgatgactgaggagcacctcttcccatcactaaaccatatgcatgaatgtgtcctataacattgagaggttattgacagactttttagtgagaacaagttagcatggtagcaagaacaaagactttggagtcagattcgcatttaaatccaggttccagacagctccggtggctcacacctgcaatcacaacactttaggaggccgaggtgggaggatcacttgaggccaggaggttgagaccatcccgggcaacaaagtgagaccccccccatctctacaaaaaaaaaattagctgggcatgggtagcatctgtagtcccagctatttggtttgtttttattttcgttttttgagtcatgattttactctgttgcctaggctggggtgcagaggtataatcatggctcactgcagcttagaccttccaggatcaagcgatcctcctacctcagcctcctgagtaactacaactacaggcacataccaccacaaccagctaatttatttttccccctggggggagaaacagagtctcactatgttgcccaggctggtcttaaactcctaggctcaagcaatactcccaccttggcctcccaaagtgctaggattacagacatgagccaccgtgcctggcctcagtttgacaaattttgacctatgtatacatccataaaaccattacagtcaagaaagtgaacatatccatcattcccaagtttatcaattttaatgctcatcccaaggaaccatctttgtttcagtgattttcactattagttttgttttctaccctttgtttctactcagatctttattatttcttttaatctgcttactttgagtataattttatcttttcctagtttcttaaggtagaagctgtggttattgacttgaggtcttcttttctaatataagcatttggtgctataagtctctccctaagaactacttagtgacatcccacatattttgatgggttgtgtttcattttcattcatttcaaaatactttctaatttcctttctgatttcttctttgatccatgggttaattaagaatatgttactcagtttctaaatatttggggattctctagatatctttctggtattttttatttaattcaattgtggtcagagaatatattttgtataacttgaatccttctaaacttactgagccttgttttatagaccagaatgtggtctatcttgcaaatgttccgtgtacatttgaaaaaaattatgtgttttgctgttgttggatggagtgttctataaatgacaactaggtcaagttgggttttttttttttttttgagatgaagtctaggtttgtcgcccaggttggagtgcagtggcactatctccgctcactgcaagctccgcctcccaggttcaagccattctcctgcctcagcctcccaagtagctgggattacaggtgcacaacaccacacccagctaatttttctatttttagcagagacggggtttcaccatgttggtcaggctggtctcaaactcctggcctcaatctacccgccttggcctcccaaagtgctgggattacaggcgtgagccaccatgtctgacccaagttggttgttattcaagtcttttatatctttgctgattttatgtctgcttgttctaccaatcattgagaaagggatattgaaatctctgtaattgtggatctatttctccttgtagttctatcagtcttcatatattttgaagctctgtaatttgatacataagcatttagtatcgctatctcttttatcattatgaaatgtattttatctctggtgatacccttggctctgaaatttgtttcttttttttactaacttattgtctgtttctctcagaagtataagcaccatgaagccaggcactgtgtcttgttttgtatccctaacacctagcagagtagctggcacttagtgaatatttaacaaatctttactaaaggaaggacagaagggagggaaggattgtaatgcatatgctgatagaggtaggcactaggaataagtgataagaaggggacagcacctgttttgaagacaatatatcataatgagtaaaataaacacagaggcaatttcaagagtgtgacatgagccaggaaaaggataagcataagattctttggaagactaaggtgatgagagacacctttcttttttttttttgagacggagtctcgctctgtcacccaggctggagtgcagtggcaccatctcggctcactgcaagctccgcctcccgtgttcacgccattctcctgcctcagcctcctgagtagctgggactacagccacctgccaccatgccttgctaattttttgtatttttagtagagacggggtttcgccatattggccaggctggtctcgaactcccgaccttgtgatccgcccgcctaggcttcccaaagtgctgggattacaggcgtgagccaccgtgcccggccctgtgtgcttattaagagtctcttggccgggcacggtggctcacgcctgtaatcctagcactttgggaggccgaggcaggtggatcacctgaggtcaggagttcgagagcagcctggccaaggtggcaaaaccctgtctctactaaaaattcaaaaattagccaggcgtggtggcacacgcctataactccagctacttgggatgctgaggcaggacaatcacttgaatccagggtgggggaagggggagggggttgcagaggttgcaatgagccgagttggcgccacttcactccacctgggcaaaagagcaaaactctgtctcaaaaaaaaaaaaaaaaaagtctctgaagttgttcctaacctgtttctgccagtagttcttgttattgcagtttgattagatattaacccagagataataaaattgaaatgcaaaagacagctgttatttctatgaggaccaagttgaatgcttttgaaagattagacagaagagccaaaaaacaaacaaaaaaaaactgttctcaaagtacatatgagagagataactataaaaattaaggccagccaggaacggtgactcacagctgtaatcccagcactttgggaggccgaggcaggcggatcacaaggtcaggagttcgagaccagcctggccaatatggtgaaaccccgtctccactaaaaatacaaaaattagccaggcatggtggcgcgtgcctgtggtcccagcttctcgggaggctgaggcagaggagtcgcttgaacccgggaggcagaggttgcagtgagctgagattgcaccattgcactccatcctgggcgacagagcgagactctgtctcaaaaaaaaaaaaaaaattaaggccaagcacagtggctcatgcctgtaatcccaacactttcggaggccaaggcaggaggattacttgagtgcaggagttcaagaccagcctgggcaacatagcaagaccccatctctacaaagaaatttttaaaaattagccagctgtggtggtacatgtctgtagtcctagctactcaggaggctgaggtgggaggactgcttgagcccaggaggttgaggctatagtaagccatgatcattccaccacattccagcctcggtgacagagcaagaccctgtctttaaaaaaaaaaaattagaaggtacattgtcaaattagaaaacttctttaaaatgatatggccaataagaacggaaagggcagtgggacgcggtggctcacgcctgtaatcccagcactttgggaggccaaggcaggcggatcacgaagtcaggagtttgagagcatcctggctaatatgatgaaaccccgtctctactaaaaacacaaaaaaaaattagccaggcatagtcacgggcacctgtggtcccagctactccggaggctgaggcaggagaatggcgtgaacccaggaggcagagcttgcagtgagccaagatcgtgccactgcattccagcctgggtgacagagcaagactctgtctcaaaaaaataaaaaagaatggaaagggcagtggaaagaaatgtgatggatgtggtgaggagggtcttcagggctttgtatgcccctctaaggtatctggattttatcctgaggtgaatggtgaacattcaaaggtgccgagcaagacggtgacagaaacagattcacattttagaaagatggctctgactacagaatacagtgaatgagcaagactgaatgcaaaaagacctgtcaggaagctgttgctgtaaacaagagataatctggacctaattaagagtgttttcactattctttttttttttttttttttttttgagatggagtctcgccctgtggcccaggctggagtgcaatggtgcagtctcggctcactgcaaactctgcctcccgggttcaaacaattgtcctgcctcagcctcccaagtagctgggattacaggcacctgccaccatgcccagctattttttgtatgtttagtagagctgggggtttaccacgttggccaggctggtcttgaactcctgacctcgtgatccacttgcgttggcctcccaaagtgctgggattacaggtgtaagccaccgcgcctggcctgtttataattttttttttttttttttttgagacggagtctcgctctgtcacccaggctggagtgcagtggtgcgatctcggctcactgcaagctccacctcccgggttcgcgccattctcctgcctcagcctcccgagtagctgggactacaggcgcccactaccgcgcccagctaatcttttgtattttcagtagagacggggtttcaccgtgttagccaggatggtttcgatttcctgacctcgtgatccgcccacttcggcctcccaaagtgctgggattacaggtatgagccactgcacccggcctgtttttactattcttaagagctaattttaaataaaaattagctgggcatggtggtgcacacttgtggtccctactaaggaggctcaagtaggaggatcgcttgagcccaggaggtcaaggctgcagtgaaccgtgattgtgtcactgcactctagcctgggtgacagaataagaccctgccaaaaaaaaaaaaaaaagctaattttatgggttaagtaagtttttctgggctttctaaggaaacaacattactgccgtagttttcatgggaaatcatattccaaacaacaaattacatgctaattagcatacaacctatttgcggactaaggactgtttgcaacttatttgcctttacaaatggtaacttctacagaagcctcatctgcttccccagttacaatcttaatctggatcatttccattgcaattgcaaaacctctttcttatgcagaggacatctaaaaacgggctgtttctaaatatgatcgtcaagaatacatctttttaaatgtttgtacaaaacagaggttaggctttggtatctgtgactgtaaactactcttggtacccagaaaagaaaataagaacacttacttcatgaaatactgctccagaatacggagatactcccaagtccaacagtgaaaggccttcaaccactgaaaaattagatatacaagttcactcagactaagcaggcagctacagaccaaattgttagatacccccacaaccaaaaagggccttagcgtttatctaaccccctttacctcatccccagcaagtggctttaagtcttgaacatttctgatgacgggaaactctctttcatggacagcatcctttttcattgtgggcagcactcattataagacagttttatgttaaactatctgcttccttttagttccttgtaactcttaccaactctcaaaaatgtctcatttatgcctaatcttccccattccaaagcacaataagataacaaattagaagctggtgagaaatgttgccatagtgtgaggaaatgggcagtcactctcatatgctgctcatttgagtgacatttgtattaacttttcgacagggcaatatgtgctttctaagtgtgtgccttctgacccagatatgatacttcttagggcagtttatcctatggaaataacctgacaagtacccaaagaggtatgttccttacactgttcagagtactgaacaattagaaataatctgaatgtccattaatgaaaatttatttcaatgaattatgacataatatatatctctatataatggaatgctttatacttaaaattatactgtgttataaataataaataacctctccctctccctctccctcaccctctccctctctctctctccacggtctccctctccctctctttccacggtctccctctccctctctttccacggtctccctctgatgccgagccgaagctggactgtactgctgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggccggtctccagctcctaaccgcgagtgatccgccaacctcggcctcccgaggtgccgggattgcagacggagtctcgttcactcagtgctcagtggtgcccaggctggagtgcagtggcgtgatctcggctcgctacaacctccacctcccagccacctgccttggcctcccaaagtgccgagattgcagcctctgcccggccgccaccccgtctgggaagtgaggagcatctctgcctggccgcccatcatctgggatgtgaggagcccctctgcctggctgcccagtctggaaagtgaggagcctctctgcccagccgccatcccatctaggaagtgaggagcgtctctgcccggccgcccatcgtctgagatgtgggcagtgcctctgccccaccgccccgtctgggatgtgaggagcgcctctgcccagccgcgaccccatctgggaggtgaggagcgtctctgcccagccgccccgtctgagaagtgaggagaccctctgcctgacaaccgccccgtctgagaagtgaggagcccctccgcccggcagccgccccgtctgagaagtgaggagcccctccgcctggcagccgccccgtctgagaagcgaggagcccctccgcccggcagccaccccgtctgggaagtgaggagcatctccgcccggcagccaccccgtccaggagggaggtgggggtcaacccccgccaggccagccgccccgtccgggagggaggcggaggggtcagccccccgcccagccagccgccccgtccgggaggtgaggggcgcctctgcccggccaccccctactgggaagtgaggagcccctctgcccggccagctgccccgtccgggagggaggtgggggggtcagccccccacccggccagccgccccgtccgggaggtgaggggcgcctctgcccggctgcccctactgggaagtgaggagcccctctgcccggccagccgccccgtccaggagggaggtgggggggtcagccccccgcccggccagccgccccgtccgggagggaggtgggggggtcagccccccgcccggccagccaccccgtccgggagggaggtgggggggtcagccccccgcccggccagccgccccgtccgggaggtgaggggcgcctctgcccggccgcccctactgggaagtgaggagcccctctgcccggccagccgcccggtccgggagggaggtgggggggtcagcccccggcccggccagccgccccgtccgggaggtgaggggcgcctctgcccggctgcccctactgggaagtgaggagcccctctgcccagccaccacccagtcttggaggtgtacccaacagctcattgagaacgggccaggatgacaatggcggttttgtggaatagaaaggggggaaaggtggggaaaagattgagaaatcggatggtggccgtgtctgtatagaaagaagtagacatgggagacttttcattttgttctgtactaagaaaaattattctgccttgggatcctgttgatctgtgaccttacccccaaccccatgctctctgaaacatgtgctgtgtccactcagggttaaatggattaagggcggtgcaagatgtgctttgttaaacagatgcttgaaggcagcatgcttgttaagagtcatcaccactccctaatctcaagtacccagggacacaaacactgcggaaggctgcagggtcctctgcctaggaaaaccagagacctttgttcacttgtttatctgctgaccttccctccactattgtcctatgaccctgccaaatccccctctgcgagaaacacccaagaatgatcaataaaaaaaaaaaaaaaaaaaagaacagctttaaaaaataaataaataataaataaataagtggaagagaaaggagagcttttccctacagagaattctaaggatcaaatgtagaaggaacaaagaaatagaaaatcaccacttggcgtactccatccatagtaataatcacaaaaggcaagaatcatcaatggatgctaaaattagtgggcaaaaatatgagaaacagaatatttgcaaggggaaaaataaaattttacatgggcggtggttcatgcctgtaatcccagcactttgggaggccaaggcaggtggatcacctgaggtcaggcgttcaagaccagcctggccaacatggcaaaaccctgtctccattaaaaatacaaaaattagccaggcatggtggcgcgcacctgtaatcccagctacttgggagagtgaggcaggagaatcgcttgaacctgggaggcggaggttgcaatgagccaagattgtgccactgcactccagcctgggcaacagagtgaaactccttctcaaaaagcaaacaaacaaaaaagcataacctcagtctaactgtgagaagacatcaggcagacccaaatggagacataaaataactggcaagtactcttaaaaatattaagcctatgtacaactactaggtatccataaaaattaaatttaaaaaattgtaaatgttaagtctgaggaagtatcccagattataagagactaaggcgacaaaacaactaagtgcaaagtggaatcacaggttggatattggactagaaatggacattagtggggcaaattgataaaattctaataaggcctgtaattagttaatagcattgtatcaatgttaattttctggtttaggtcattgcactatggtgatgtagaatgttaacattagaaaaaggtgaatgaaaggtaaacaggaactcttgtaacttttttgaaaatctaaaattattttaaaattaagagttaaaattaaaaagtacactagagatctatatttaatgaagaaaagcagcccataaaatattcttaaatgaaaagtaggtcaaaagacagcatataaaatataataggtttttttggtgatttttttaaatgactattttagcaatttctcttggcttttacttattttcctttgcaaattttctgggggttgagggggtacatgtccaggtttgttacatgggtaaattgcatgtcatagaggtttggagtgcagataatctcatcacccaggtaataagcacagtacccgacaggtagcttttccatcttcaccctcctcccaccctccaccctcaagtaggcccaggtatctactgctactttctttgtgtccatgtgtactcagtgtttagcttccacttataagtgagaatatgctgtatttggttttctgttcttgcattaatttgcttaggataatgtctccagctccatccatgttggtgcaaaggacatgagctcattctttttttttttttaatgctgcatagtgttccatggtgtatatgtacattttctttatccagtccaccactgatgggcattcaggttaattccatgtctttgctattgtgaatactgctgtgatgaacatacacatgcatgcatctttagggcagaacaatttctattcctttaggtatatacctagtaatgggattgatgggtcgaatggcagttctgttttaggatctttgagaaatcttcaaactgctttccacggtggctgaattaatttatattcccaccagtcgtgtataagtgtttccttttctccacaaccttgccagcatctattattttttgactttttaataatggtcattctgactggtatgagatagtatctcattgtggttttgagatagtatctcattgtggttttgatttgcatttctctaatgactaattatgttgagcattttttcatatgcttgttggccacatgcatgtcttcttttgagatgtgtctgttcatgtcctgtgcccccccgccaactgtttttccaagacaggttctcgctctattgcccaggttgaagtacagtggcatgatcagggctcactgcagccttgacctctcaggctcaatcgatcctcccacctcagcctctcgagcagttgggacttcaggtgtgcatcaccatgcctggctaatttttgtattttttgtagagatggggtttcaccatgttactcaggctggtctcaaactcctgggctcaagcaatcttcctgcctcagcctcccaaagtgctggaattacagtggtgctggaattacaggtatgagccaccatgcccagccctttgcctttttttttttttttttgagacagagtctcggtctgtcacccaggctggaatgcagtggcttgatcttggctcactgcaacctctgcctcctgggttcaagcaattctcctgcctcagccacccagtagctaggattacaggtgcctgccaccagaccacctaatttttgtatttttagtggagtcggggttttactatgttggccaggctagtcttgaactcctgacctcaagggatctgcctgcctcagcttttcaaaattgcacatttttaaataggtttgtttgtagagttttatcttaaacttttataagcattcatttaattatttgaaagagagagaatgaacatgtactcaatgagaaatgcctggaaaaataaatatttaaatgttcacaatgaccatttctaggtgataagattacagaagatgcttgatttttttcatcttcattttatgaatctttagcaatgaggatgtattattttacaattattcaaaagaagtagtttttgtttttgttttggagacagggtctcgctctgtcatccagactggagtacaggaattacaaacgtggctcactgcagcctcaacctcctgggcacaagcgatcatcccacctcagcctcccaagtagctgagaacacaggccaatgccactacacccagctaaatttttttttggtagagacagtgtcttgccatgttgcgcaggctggtcttgaactcctgggctcaagccatcttcccaccttgacctcccaaagtggtgggattacaggcgtgagccactgcacctagctactttttatttttgaatcatgtgactgagttacctattaaaaaataggtaggcagggattcaaggagttcaagatcagcctgggcaacataaggagaccctgtctctataaaaaaacaaaaattagctggggcatggtgatgtgtgcctgtggtcccagctacttgggaggctgaagtgggaagatcaattgagcccaggaggtcaaagctgcagcgagtcatgatcatgctactgcactccagcctgggtgacagagggaaaccctgtatcaaataaacaaaaacagaaagaaaagaaaagaaaaaagaccactacatatttgtaaggagtgggctataattatgactttaaactttataagactaccctaaagaaggtagggtagtcctataatcaattttataattcatggtggccataaaataaaacaaagcatattgctcaagaccgttgtaactggtccttatactgcaaccaaaaggaaatctcaaggagctgcataaagaggttgctgcgtaatagctattaaatccttcactaacagctttactggagacccaaggagataattcatcaggtcaaatcacaaggcatttctcaatcttagccaatggcatcctaccacagagcagtaaaaaagcaactctacagggcaccagtatgcggccgtccaggcacatcactctccacttgtctggtttaatccagatggaaatttttgagacacagcttgaggacagactgcacaacttttaggcaattgcctaaaatgtaattcatctcagatatgcttttgctagatactgtatatcagtggatttgttagtgtattctctggcaaatgcctggagtgtggctctgctatattgatgattaaatatggcatcatattacttaattgataactgatctgggcaaagggtcagactatgtaaaacatgtaaaacatttttttgtctttcttttttgagactcactctgttgcccgggccggagtgtaatggcttgatcatagctcatcgcagcctcaaccttccaggctcaagtgatcctcccaccccagcctcccaagtagctgggactataggtgcatgccaccacacccagctaatttttaaattttttttgtagaaacgggctcttgctatattgcccaggctggtaaaaacatttttaaaaaccctaccatttactacaatattaaacagttgaccgggcacagtggctcacgcctgtaatcccagcactttgggaggcccaggcgggtggatcacctgaggtcaagcactcaagaccagcctggccaacatggtgaaaccctgtctttactaaaaatacaaaaattagcctatttgggaggctaaggtagaagaatcgcttgaacctgggaggtggaggttgcagtgagacaagattgtgccattgcattccagcctgggcaacaaaagtaaaactccgtctcaaagcataaaaaataaaaaaccaacaaaaaaaagtatatggctgggcatggtggctcacgcctgtaatcccagcactttgagaggccaaggagggtatatcgcttgagctcaggaattcgagactggcctggaaacatggtgaaaccctgtctctaccaaaaatacaaaaaattagccaggcatggtggagagtgcagctactcagcaggctgaggtgggaggattacctgagcccaagagttcaaggctgcagtaagctgtgattgtgccactgcactccagcctgggcgacagagccagaccccgtctcaaaaaaagaaaaaaaaagtataggaagaacataaactcagaatattttttgtttgtttgtttttgagacagtctcacactctgtcgcccacgctagagtgcagtggcatgatcttggctcactgcaaccttcacctcccgggttcaagcaattctcctgcctcagcctcctgagtagctgggattacagatgcacaccaccatgtatggccaatttttttttttttttttttttttttttttgagactgagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggcccaattttttttgtatttttagtagaggcggggttttaccatgttggccaggctgatctcacactcctgacttcatgatctgcccgcctcagcctcccaaagtgctgggattacaggcgggagccaccacgcctggcccagaatatttttaatggaatacatttagttttaatgataaacttattactatccttacttttctaattttggtgcacacgattaaaaactgtgacctggtctgcagtgcatttggaaacatctaaggtacatagatgtttcatctatgtacatctaaggcacataaaacatactggtacaagagtaccaacatcctctttaaaatagtgaatctactctccatagaaaagaataatcagggctgtcaaattctaatatatataaaaatgttccaataggctgagcattgtaatctcaatacgttgggaggccgaagtgggtggatcacctgaggtcaggagttcaagaccagcctgaccaatatggtgaaaccccgtctctactaagaatataaaaattagccaggcatggtggcatgcacttgtagtctcagctcctcgggaagctgagacaggagaactgcttgaacccagaatgcggaggttgtagtgagccaagatcgtgccactgtactccagcccgggcgatagaacaagactccatctcaaaaaaaaaagttccagtaatatcatgctgaaaacactttaaagtcagtttcacaaagtgcctattagggggaaaaaacaaaaagacaataaagatacccatagaactcaactttatgcctttctttttcctggagtatcctccaaaaataaaacctgtgaaaatacaccagagcatccaagtaacatttctcacttcatgggactattatctaacaactaatataagagctaaataattatggccaactattgtaaaatgtaagtttttttttttttgataaagactctcaactcttaactgataactaacccatgaagcaagcttatttaattaattaatttatttatttatttatttttagagacaggggccttaatcttttgcccaggctggaatgcagtggcacaatcagctcactgcagccttaacctcccgggctcaagctcagcctcccacgtagctgggactactggagtgcaccactgcacctgactaattctttttttttttttttttttttttttttgagacagagtctcgctctgtcacccaggctggagtgcagtggcgcgatctcggctcactgcaaactccacctcccgggttgacgccattctcctgcctcagcctcccgagtagctgggactccaggcgcctgccaccacgccaggctaattttttttgtatttttagtagagacgaggtttcaccgtattagccaggatggtctcgatctcctgacctcgtgatccacccgcctcggcctcccaaagtgctgggattacaggcgtgagccaccgcgcccagccagcacctgactaattcttattttttgtagagatggggtcctgctatgttgctcaggctggtctcaaactcccggcctcaagcgatctacccaccctggcctcccaaagtgctaagattacaggcatgagccactatgcctggccaataattcttagttaccttggtatacttttcctatgggtgataataaaagcatatcatcctgtataagacaaatattatttttcagtttcccgtatcaataaggacaaaagcttgttcaaaagcagtagtgtccctatacttctagctgagggcctaagaagcagcatcactccagctgcaatgaacacacctagcattcagaactttgtttctaaataacattctctaataaaaggagccagggcccttgaagaagtggtcaattccagggctgaactaagcaagataaacctggatcatcttatagttctagaatgtaataaagtgcttttaaaaaaaaaaagtgagatagaggtatggcaaaaggacaaaggggtcaagatgaaagcggtcccaatggccaaaactagaataatccaaacaacagaatgaatatagtatacagagtccagagtataaaatatccaaatctatactgacataaatagttaaataaatgcaaagaaatgacaactcttccttacagaagaattttaattattaaataaaaatgaatgagagaaacagaaaagtcaccattgaaacacctgagtaatgactgttacaggcaagattaacctatgaatgcaaaaattagtaggcaaaaatttaaaaacaggatatttgcagagctccaaagaatagcccctaaaatgctgattaattacaaagggaaacagtcactttatggtggagaaatctggcagacactacattaaccaagggattatggctgacatcaccagtattagggcatttcaatatgcacccctgatccaatgcactgagaggaccatatcatctcaggggtattcttccccaaaatccattacctccgtcaaaccacaagaaaacattagacaaaaccaaattgagggacattctacaaaatacctgaccagagctcttcaaagtgtcaaggtcataaaagatgaggaaatgctaaggaactatcacagataaacgactaaggagatataacaactaaacgcaatatgtggccaggcgcggtggctcatgcctgtaatcacagcattttgggaggtcgaggcaggtggatcacctgaggtcaggaattcgataccagcctggccagcatggtgaaaccccgtatccactaaaaatacaaagattagctggcatggtggcagggacctataatcccagctactcgggaggctaaggcaggagaatctcctgaatctgggaggtggaggttgcagtgagccgagatctcgccactgcactccagcctgggtgacagagcgagactccgtctcaaaaaaaaaaaaaaaaaaaaaaggggggggcgggcgtgctggctcacacccgtaatcccagcactttggaggctgaagtgggcaaatcatgaggtcaggagatcgaaaccatcctggctaacatggtgaaatcccatctctactaaaaatataagaaattagccaggcgaggtggcgggcacctgtagtcccagctactcgggaggctgaggcaggagaatggcatgaaaccggaaggcggagcttgcagtgaaccaagatcgtgtcactgcactccagcctgggtgacagagcgagactctgactcaaaaaaataaataaataaataaataaaataaaaataaaaatgcaatatggaatattagatcatagaacagaaaaaaaattagtgaaaaaatggtaaaactttttttttttttttttttttttttttttttttacacagggtcttgctctggtgccaggctacatacagtgcagtggcatgatcatagctcaatgcagcttcctcatcccaggctcaagcaatcctcccacttcagcttcccaagtagctgggaccacaggtgtgcgccaccaaaccagctaactcttttttaattttatgtagagagggagtctccctatgttgcccagactggtcataaattccagagctcaaggcatcccctcgcctcagcctcccaaagtgctgagattataggcatagccactgtgcccagcaaaaatggtaaaatcttaacaactatggtttagttaatagtattgtaccaatgctatcatcttagttttgatcactgtactatgactatgtaggatattaacattgggggaagctgggtgaagggtatacagatctctctgcaatatttttgcaagtattctgtaagtttaaaatgatttcaagtaaaaagctaaaaaacaggctggtgcagtgactcatgcctgtaatcccagcactttgggaggcagaggcaggtagatcacttgaggtcaggaattcaagaccagcctgaccaacatggtgaaaccctatctctaccaaaaatacaaaaattagctgggtgtggtggcacacacctgtaatcccagctactcaggaggctgaggcaagagaattgcttgaacccaggaggtggaggttgcagtaggccaagatcacaccactgcactccagcctgggcaacagagtgagactctggctgaaaaaaaaaaaaaaaagtaaaaaacaaaaaacagtggtatctagtctctggatccagctgcctatttgcaggaaatagagatgatagaggaacatgttaaattgtatcatgatatataatcaggaaaattcaaactatgggagatctgtctggattcttcaatagataaacactatggaagagaaagggaacctgggaccctaaaaattaagagagattgaaaacacaaacaaaaacttttttcttaggggcaagactaagcctaacggcaaatgaactagggatgttcatttgagtaataaaacttttaaaaatacaaagatgtcattacatataaaagtcaggataatagttacttatgaaaagagtgaggggattgtgacgaaggggggcttctgaagtgagtggcaaagttctgattcttgacttggatgacagttacaaaaatgttcaccttacaataattcaccatagaatacattgttatgtgtgtcttacaaattctgtttaattttgtaataacggctttttttttttttttgagacaaagtcttgctctattgcccaggctggagtgcagtggcatgatctcagctcactgcaacctccacctcctgagttcaagtgattctcctgcctcagcctcctgagtagctgggactacaggctcctgccaccacacccagctaatttttgtatttttagtagagacaaggtttcaccatgttgcctaggccggtctcgaactcaagctcaagcaatctacccacctcccaccttagcctcccaaagtgctgggattacaggtgtgagccacctcgcctggccataaaggcttttttaagtagtggtatcagaagtgctcttcctgaccctgattcttttatttttgagacaaggtcttgttctgtcgcccaggctggagtgcagtggtgcaatcttggctcactgcagcctccacctcctgggctcaagccaccctcccacctcagtctcccaggtagctgggactacaggcacacgccaccatacccacctaatttttgtatttcttttttgtagaggtggggtttcaccatgttatccaggctggtctcaaactcctaagctcaagtgatctgcccacctcagcctgccaaagtgctgggattacaggcttgagccaccatgcccagcaaccctgattctcatagctgtagtaggggtgggtttctagataagtactaatagcttgggctctaccctgaactcaaaaagctaagcctatacgaactgtcaatctttgggtgaaagcctcaggaaagactaaaacatggcagaaagtttctaacattattcctgacagatatctaaacaagatgatactggtggaacagccatacctaaagattgctagctcttcatacaaaatattattagcgaggtcaccttgggcaaatgacttaatctctccatgcctcaattttctcatttataaaatggggttgataacagtttgccattttagagatcaaattagtgcattaacacacctaaagtgcttagaacaataccaggcatgtaaaaagcatcatatcattgttaatttctttcttttcttcttcctttttttttgagacggagttttgctcgttgcccaggctggagtgcaatggcgcgatctcggctcaccgcaacctctgccccccgggttcaagtgattctcctgcctcaacctcccaagtagctgggattacagtcatgcaccaccacgtccggctaattttgtatttttttagtagagacagggtttctccatgtcggtcaggctagtcccgaactcctgacctcaggtgatccacccacctcggcctcccaagtgctgggattacaggcgttagccaccgtgcccagcctgttaatttcttattaattttttagaagctcctgcttttgtcaaacaggaaattcattccttaaaaatttatttcttggccgggcgcagtggctcacacctgtaatccaccactttgggaggccaaggcaggtggatcacctgagatcaggagtttgagaccagactgactaacatggtgaaaccccatctctactaaaaacacaaaattagccaggtgtggtggctcatgcctgtaatctcagctactcaggaggctaagacaggagaatgaatcgtttgaacctgagaggcagaggtttcagtgagctgagattgtgccattgcactccagccagggcaacaagagtgaaactccttctcaaaaaaaaaaaaattttctttttttataaggcagagtctcactctgtcacctaggatggaatgcagtggcacgatctcggctcactgcaccctccacctctgcctcccgggcccatgcaatcctcctgccttagcgtcccgagtagctgagactacaggtatgggccaaacatgtccagctaatttttgtatttttttgtagagacagagttttgccatgttgcccaggctggtctcaaactcctgggctcaagtgatcctcccgcctcggcctcccaaagtgctgggattacaggcatgagccacaaaacccggcctggaaatttatatgtattttagttacactatcaaataaaccgatggatttgtagaaataggtaacagaaaagatatttttcctgttgaaatggatatgttatttgtgcctgcccaacatcaatcttcccttcttttggtaacagcaccctaatttttcctatgggataccccccttgtgtacattttgggtgagactgcctcctttccaaagaggtagatacatgacccaggcagactacagtaattgaccgaagaattggtatatgacccaaatcagttcaatgtgacttaattccagagctttcgttgcacttattcaaaaaaaaagaggtcaggcatggtggctcatgcctataatcccagcactttgggaggccaaggcagaaggatcgcttgaggccaggagcttaagaccagcctaggcaatatattgagaccccatctctacaaaaaacaataaaaaacaattagcaaagtgtgggagcatgcaccaatcccagctgtttgggaggctgagtcaagaggatctcttgagcccagaaggatgaggctgcagagaattatgatcatgccgctgcactccagcctgggagacagagtgggaccctgtctctcaaaaaaaaaaaaaaaaaaaaaaaatcagtccatactatagccaatcaaaatctatttggatttggatccagggcccctttacccaaagaactgatcattcaaaaatttaaaatgtcagcccggcgtggtggctcacgcctgtcatcccagcactttggaaggccgaggcgggtggatcacgaggtcaggagatcgagaccatcctggctaacatggtgaaaccccgtctctactaaaaatacaaaaaattaaccgggtgtggtggcgggtgcctgtagtcccagctactcgggaggctgaggcaggagaatggcgtaaacccgggaggcggagcttgcagtgagctgagattgcaccactgcactccagcctgggtgacagagtgagactccgtctcaaaaaaaaaaaaaaaaaaaatgtaaaatgtcatgtgaaaccagaaggagtcctactttactatttttaaattcctgccttttagggtttatataatcagctgctttaaaaaatatcccatttaaggtaccctttgaagaaaagtaatgcttacagatgttgtaccttccctcccaaatgatacaaataatcatgctgatttagtcagatccagatgatgggtggttaacaaatctctctctctttctagtcctgacactggcctcaagctccagacctaaacctgtcagtattgtactatcacattatacacacatgaaacactactatgtcctttctgattcatctatttcagcccatgtcagcactatttttcctaatatctcaactcaaaaccttagaattcacctttttggctttcattattgtgttgagcttcaacatggattatctcgttgaacaggatacataatttcctattttacagatggaaacactgacgttagaattcatacagcttggccgggcgtggtggctcacgcctgtaatcccagcactttgggaggccaaggcgggcggatcacgaggtcaggagatcaagaccagcctggctaatatggtgaaacctcgtgtctactaaaaatacaaaaattagccaggcatggtggcatgtgcctgtagtcccagctacttgggaggctgaggcagaagaatcgcttgaacctgggaggcagaggttgcagtgagccaagatcatgccactacactccagcctgggcaacagactgagactccatctcaaaaacaacaacaacaaaaaaagcttggcgcagtggctcatgcctgtaatcccagcactttcacaggtcaaggcgggcggctcacctgaggtcaggagtttaagaccagactagccaacatggtgaaacttatctctactaaaaatacaaaaattagctgggcatggtggcgggcacctgtaatcccagctacccaagaggctgagacgagataacagcctgaacctgggaggcggaggttgcagtgagccgagatcgcgccattgcactccagcctgggcaacaagagcaaaattctgtctcaaaaaaaaaaagaattcatacagcttataagttgcagaactagagaaagagtcaaaccttttctgagattccagaccctgcactcttaattaccaaacaacactgtctcatctttggatccttcacctgtccatcctgtaagtaacctcctgtaagtaaccagatcctatgctttcttctcttccacatttattcaacagtaactacacacctactgtatgccagacataaaagaattcaggaatgaataaaacagaatccttcaaggagctcataatatagtggaaaaggccaggtgtggtagcttatgcctgtaatcccagcactttgagagacccagatgggcggatcacttgagcccaggagtttgagaccagcctaagcaacatggtgaaaccccatctctacaaaaaatacaaaaaaataataataataacaagtagggttggtggtacatgcctgtagtcccagctaccaactacttgggaggctgaggagggaggatgtcctgagcccgagaggtcaaggctgcagtgacccattatcactgcactccagcctgagtgtcagagtgagaccctgtctcttgaagaaaaaaaaaaaaaaaaagaggccaggcatggcggctcacacctgtaatcccagcactttgggaggccgaggaaggcagatcacctgaggtcgggagttcaagaccagcctgaccaacatggagaacccctgtctctactaaaaatacaaaattagccaggcatggtggtgcatgcctgtaatcccagctgcccaggaggctgaggcagaagaattgcttgaacccagggggcggaggttatggtgagccgagatcgcaccattgcactccagctagggcaatgagagtgaaactccatctcaaaaaaaaaaaaaaaaaaaaagagagagagagaaaatgtggaaaaaccggatataaacaggtaattatgagataagaaatgctcttagtagggtgtagaggaagaagggcctaatactgcctcaggttttcagttatccagaagaaaacaggaaccaaatggcttcgattcatttcaacagaaaaataatacgcagaggtaacaaatccaagctcttacaatctcagacatgaattattactatctttattaccattccccaactaggaaacctgggcaaattaacttctctaaatttcagttccctcatctgtaaaagggggaaaataacaccatctatcacatagaaataaatgtgaggactaaatgagaaaaggtatatgttaccatttttagaaaccttaactctattcataaaacacccattcattatgccgttccccataccaacattctatgggataacatcaaaacgttagccttggccaggtgccatggctcacgcctgaaatcccagcactttgggaggccaagtgagactgcttgagtccaggagttccagaccagcctgggcaacatagaaagaccctgtctctaaacaaaaaacaaaaacaaaaacaaaaaaactttagcatttaaaggacacaaaggggacttctggggtgctgatactgtttcttgaactaggtgctggctacatgagtgaatacagtttttaaaaattcattgaactctacacttacttaatatgcattgtatgtatactgtacttcagtaaaaaaaaaaaaaaaaaagttgtttgtttttttttaatcatcaaactctggcctaaacctagcttccaccccattactcccctgctttggacatttcacatccttgaacgtttcttcatcctatttactttctgctacctggaactctccttttctctaatctccctttcaaaaccctacatccttcaagagtcagctcaaatcccacattctggaaaactggaaaggtaggggatagtttattcagggtcagaatactaaggaaggaactgggtggacacataaagtatacttttcatgaattattataacgatttgtctccctcactagcctgtgcagctacttcaggccaacttcgctttctcgctgtaggcgttagtataaaacaatgttcggtgaagaacttagtaaggaacagtaacaaaaattgccctgcaagtcccagactgagaagagacgtctaaagcacacgcacactctcctcgcttaagcaaaattggtcccctcatcccggaccccctcacacataaccttttatcccagggagcacccctggcgatcccgccccaaatcccaaactcctctgcaagccgcgctccacaagcacctcctcctcttattccaacccttcccacagaccacactcctcggctcaggacactgaatgggacacgccccctcagatccccaccactaggtggtccggcccccagggcccaaacctcacgacactgtccccacgccccggtccccacgccccctcccctcaccagccccgccctcaggccccgccctctccaagaaccccacgagacagtcagttagttctctaggaaccgcgcgctggcggtcactgcccccgcctcccattcacagaggccgcgggagggcaggtggggcctgacagtctgctcgagccagtggcctcacctctcttccaagagctcagtggggacaccacctccacccgctcggaaatgaactcggccagactggagcggaacaaggccgcccgcactgtcacagccaccaccagcaccaggaccaagggagccgccatgataactggggcgggcgcgcgggcggggagggaaggcgaggcggaggagcctcgcgcgctgtgcgccacgctctgtagttccgcgggtgggcgcgcgctgccgctggcgccggagaggccagacgtggggactacggctcccagaaagccttgcggcgaggcgggccggagcgacggaaagcgggcgcctcaagctgcgtatgcagaaggtggggcgaaaccttctacgatcgcaggtgttttgtgaagccgcgccgctatagcggggctgaaacgctgctgaaagtagaagcggaagtagtcgccttcctgggattgtgagagacttttaaacagatgttaaattcactcttgcgtgtatgttttcaatgccaaaatgtttatttttatttttatttttattttttttgagacggagtctcgctctgtcgtccggctggagtgcagtggcgcgatcttggctcactgcaacttccgcctcctgggtagctgggatgacaggcgcccaccaccacgcgcggctattttttttttttttttttttttgtatttttagtagagatggggtttcaccatgttggccaggttggtctcgaactcctgacctcaggtgatccgcccgcctcggcttcccaaaatgctgggattacaggcgtgagccaccgcaccctgcccaaaatgtttatgttttttgtttttgagacagggtctcagtgccgtcgcccaggctggagtgcagtggcgcaatctcagctcactgcagcctggacctcccgggctccagagtagctgggaccacaggtgcgcgccaccacacccggctaagtttttgtacttttagtagagacggggtttcgccatgttgcccaggctggtaccttttatgtttttaaagagtgttaaatgtgtattttttaaaaaatttattctggcagttgtttgttaaacgccaactattttccaggcactatgttaggttctacagatgcgttttggagtagtagactgatttattagctagttcaacaagtcgcttaacccttgtgtgctgaaaaatgtgctgattataggctaactagggacagttgaggaaggcttagaaattttttttttgttttggaaacggagtttcgctcttattgcccgggttggagtgcaatggcgcgatctcagctcactgcaacctccgactcccaggttcaagcgattctcctgcctcagcctcccgagtagctgggattacatgcatgcgccatcacgcccggctaattttttgtaattttagtagagacagggtttctctatgttggtcaggctggtctcgaactccagacttcaggcgatccacctgcctgcctcggcctcccaaagtgctgggattacaggcttgtgtcatcgtgcctggccggaaggcttagaaattttgccagtcgcttttaaacacaggcatttttgaaaattaagacatataaacctacagttaaataacttatattgaaaacaacggaatacatattcaacacgtcactttctaattattttactacacttttttttatatgtgcttttgagattatttaccaccgctgtatcagtacagcaaatactatctctttctcttcccaaatggtggtgttcagtttcctcaggttgatagattgaaaatccctcccaatgcgagtgtttacaccacaggaatcagcaaacactacaaatcaggggtttggggtttggagagcccattgataagcattaagcagcacacttcattaattaatgtatagtaagtgcttaaatattagcaataataatattaaatgtgcaaggaaatttcatatttgtgaagaaaaggaaacaggctggacgcagtggctcacgcctgtaatcccagcactttggaaggccgaagcagccggatcacttgaggtcaggagtttgaaaccagcctgcccaacatggtgaaacctcgtctctattaaaattacaaaaattagccaggcatggtggcctgtgcctgcagtcccagctactcaggaggctgaggcaagagaatcacttgaacctgggaggcggaggctacagcgagccaagatagcgccattgcactccagcctgggcgacagagccagactctgtctcaaaaaaagaaagagagagaagaaagaaaacgaaacagtgtatgactgagaataactgctggtgtaataataagggtggtaacactagacaaggtgatcagggaagactctagaaagaggtgatatttgagctgagacctaaaggatgagaaattaatcagagcctccaagcagaaggaacggactgagtggggaaagagcaaggtatgtttgaggatcagaaagaaaacaagtatggctcaagtggagagaatagaagaagctgtggatggagagacggggggcaatcaggtagggacctattggccatgcttgagaatttgggctttattcaaagtgcaatccatatgccattggagaattttaaaccagaaatgatgtgaacaggtgtacatttttcaaacatctctatattcccacaagccctctattgggtgttggggaatattgcagtgacaaaatggcaccatctgcctttgcccttatgtaacttggaaagcagttgaagagataaaatagttaaagaataacataagtaaaatcacaaaccataactccagcctgggcgacagagcaagactccgtctcaaaaaaaaaaaaaaaaaatcacaaaccttaatgagagaaagaaaagggggagtgggccaggcgcagtggctcacgcctgtaatctcagcactttgagaggccatggcgggaggattgcttgagcccaggagtttgagaccagcctgggcaacatggtgaaacctgtctctacagaaaacataagaattacccaggcatggtggcgcatgcctgtagtctcagctactgggaaggctgaggtgggagaatcacttgagcctgggaggttgaagctgcagcgagccaagatcacgccgctgctctcaggcctgtacgacaaagcaagaccttgcctcaaaaaaaaaaaaaaagaaaaaagaaaaaaaatggccgggcgcagtggctcacacctgtaatctcagcactttgggaggccgaggcaggcagatcacttgaggtcaggagttcgagaccagcctggccaacatggtgaaaccccgtctctactaaaaatacaaaaaatttagctgggcaaggtggcgggcacctgtaatcccagctacttgggaggctgagacaggagagtcacttcgacccgaggatcggcggttgcagtgagccgagattgcaccactgcactccagcctgggcgacagagcaagactgtctcaaaaaaaaagaaaaaagaaaaagaaaaaaatgggagtgggattctaaaagaatgcaaaaataaaccctggggctgatagctttctggaccagtgaaaggggtagggtctcctttgggggaggggatcatgaagaaattagaggggcactcatcctttgagcccctgctgtgtgccaagtagtgtaccatatgcttaacacacatgagcttatttagtctgcacagccttccttcttaaagatgtgggtttttgtatccccttttacataaaaggagatatatgtgttgcatcatcttacagtgaagtgtattacatcataaaaagtggaagtaattgtaacactaacctcatagtgaatattgagcaaggttatacaatgtaaaatgcttagcacatacccagtgctcagtaaaggttacttagctgttatattatttacatcattctaacagatgacttaaaaatttatcttagggtgaggattgtctttgggaaaaacagtgattagccattgtagacagatgtgacccaaaccagtggttctcaaaatgagtgtgcatgaagtatgaatacaactagtggttctcaataaaaaaacacaagacccaaatacagaagctagaattataaaactcataaaagaaaacataggagtaaacttttatgacctttaattaggcaatggtttcttagataacaacaccaaaagcacaggcaacaaaaggagaaataagtaaattgagctttgtcaaaattaaaaacttctgtgttccaaaggacaccatcaagaaatgaaaactgctgggcacggtggctcatgtctgtaatcccagcactttgggaggccgaggtgggcagatcacttgaggtcaggagtttgagaccatcctggccaacacggtgaaaccccgcctctactaaaaatataaaagttagccaggaatggtggcgggcacctgcaatcccagctatcgggaggctgagacgggagaattgcttgaacccaggagctaatgttgcattgagccgagatggtgccactgcactccagtctgggcaccagagcaggactctgtctcaaaaaaaaaaaaaaaatttaaagactgggcgcggtggctcacgcctgtaatcccagcactttggaaggccgaggccggtggatcacaaggtcaggagttcaagaccagcctggccaagatggtgaaacccccatctctattaaaaatacaaaagttagccagtcgcagtggcaggcacccgtaatcccagctacttgggaggctgaggtgggagaatcgcttcaacctggggggtggaggttgcggtgagctgagatcatgccactgtactctagcctgggcaacagagtgagactccatctcaaagaaaaaaaaatttaaaaaagagaaatgaaaactggctcaggcctgtagtcccagcactttgggaggctgaggtgggaggattacttgagcccaggagttcaagtccagcctgagcaacatgataagacccccatctctacaaaaaattaaaaaaaaaaaagccaggcacagtggttcacacctgtaatcccaacactttgagagaccaaggtgggtggattgcttgagctcaggatttggagaccaacctgggcaacatggcgaaactccatctctatttaaaaaaaagaaaaaataaatacaaaaatgagccaggcatgatggcatgcacctgtagtcccagctactcgggaggctgaggtgggaggactgcttgagcctaggaggcggaggttgcagtgagccaagattgtgccactgtactccagcctgagcaacagagtgagaccccttcaaaaaagaaaaaagaaaacccacagaatgggagaaaattatctgcaaattatatatttgagtagggacttatccagaatgtttaaagaactgttacaactcagtaataaaaagacagtaataaaagacaaatacccaaatggagaaaggaattgaatagacatatcaccaaagaagatacacaaatggccaataagcatgtaaaaagatgctcgacattattagttattagggaaatgcatatcaaaaccacaatgcgataccatttcaaactcaataggatagctataataaaagactgacagtagaccaggcgcgatggctcatgcctgtaatcctagcacttttgggaggccaaggcgggcagttcatttgaggtcaggagttcaagaccagcctggccaacatgttgaaaccccgtctctacaaaaaatacaaaaattagctaggcatggtagcacacgcctgtaagcccagctactaaggaggctgaggcaggagaattgcttgaacccagggggcagaggtttcagtgagccgagatcacaccactgcactccagcctgggtgacagagcaagactccatctcaaaaaataaaataaaaataaaactgacagtaacaagtgttgacaaggaagtggagaaattagagcttttatacatggcaggtgggaacataaaatattgtatccactttggaaaacaggttggtatttcatcaagatgttaaacagaattgccttatgacccaccaactcaacacctagctatatatctgagagaaatgtaaacgtatgtccacaaaaaaaattatgcacaaatgttcatagctcattcataaaaccaagaagtggaaataacccaaatgaatggataagcaagatgtggtatacctacaatggaatataactggacaataaaaaaaaatgaagtagttatccatgctgcaacatagatgaaccttgaagacattatgctaaatgaaataagccagtcacaaaagaccacatgctatgtaattccatttatattaaatgtccatgggtgggcgtggtggcgcatgcctgtaatcccagcactttgagaaactgaggcgggaggattgcttgagccccaaagtttgataccagcctgagcaatataggggagactccgtctctataaaaaagtaaaacatggccaggtgcggtggctcacccctataatcccagcactttgggaggccaaggtgggtgcgtcacctgaggtcaggagttcgagaccagcctgaccaacatggcaaagcctcatctctactaaaaatacaaaaattagccgggtgtggtggcatgtgcctgtaatcccagctactcaggagactgaggcgggagaatcactttgaacccaggagacagaggttgcagtgagcgagactacgccactgcactccagcctgggcaacagagcaagaatccacctcaaaaaaaaaaaaaaaaaaaaaaaagtaaaacattagccaggaatggtggcaggcacctgtggtcctagctactcaggaggctgagacaggaggatcacttgagcctaggaggtagaggctgcagtgagccgtgtttgtggccactgccctctagcctgggtgacagtgagactcttcctcaaaaaatattaaaaaagagagaaatgtccagaagagtcaaatttatagaggcagaaagtagattagtgcttgcctagggctgggggtggtgactgggggagtagggaatgggaaatgactgccaataggtacggagtttcagctgggtgcggtggctcatgcctgtaatcccagcactttgggaggctgagggcgggggtggatcacctgaggtcaggagttcaagaccagcctgaccaacatggagaaacgctatctctactaaaaatacaaaattatctgggtgtggtggcgcatgcctgtaatcccagctacttgggaagctgaggcaggagaattgcttcaacccgggaggcagaagttgcggtgagctgagatcacgccatttgtactgcagcctggacaacaagagtgaaacctcatcttaaaaaaaaaaattagtaagcatcagaatcacgggggagatgtattttttattttatttatttttatttttcataaatagagatgggatcttgctatgttgcccaggctggtcttgaacgcctgggctcaagcgatcctcctgcctcagtctcccaaagtgctgggattactggcatgaccagcctagatttttgaagtgtaaattttctagttctgacctagagactaggcctggtgtggagcccaggaatctacattcttaatctctccaggtaattctaatgtttgtgattcagaagccataccttgggaaacaaaaaaataaccctgaaggcgtaggtgtccagtagcttacacaaaaaaagatgaatatagtaatgataactagcaaatattgagtgcttactaggtgctaagtactgttttaagtgctttacacatattatctcatttagtacatgtaccgttacaagtgctatctattatttctccatcaccaatgaggaaacagaggcacaaagaggtttagtaacttgcctaaggtcacatggctagtaagtggcagaaccaggatctgtctgttagctctagatactgtggtcaagctgctctgcctgagaaaatgagaagaatttgggttgtgttggattgggttgtgttgggttgggttgcgttgggttgggttgggttgtgttgggttggattggggtgctttcttgttgtagctgagaaggaagggtagggaatagaaaggaaggagataataaaggagcaatcatggtgttttgttttgtttttttcctgtgacaccagagattcctgtgatatgtgggttacctagagaggaagaaattgaggtgctaagatactaagtaaccactggaatgagtgaattgcaatcagtttttaatgaccttgcatctttccattcaagaatcagcattcttggaaaaagcgcaagattgattaagattaggtcttgtgcccaatcttaatcagccagaaaagtgtatctgtgagaagtcagatgatgaatttaccatattcgcctgaggacagcacaccctaaaggcaattggatgaagtcagttcgaggaaggcgaaagggtacagtcctgtgctgcataaagacattttggtcaacgttggactgcatataccacagtggtcccctacgattatagtggagctgaaaaattcctcttgcctactgatgttgtagccatcataacatcgtggcttaatttgttatcttttctatgtttccatatgtttagatacacaaatacttaccactgtgttacaattgcctgtagtatccagtatagtaacatgctgtacaggtttgtggcctgcaagcaataggctataccatatagcttaggtgcgtagtaggctttaccatctaggtttgtgaacctgctaataataatagtgatgacaaagacagacccaggcctccctgtactgtggtttatagtctagcagggagtcatacaaaatagaagtaagcaaacaaaataattagggactgtgaccacaccaaaataagtagggattgtgagggcaaaagaccaggaagaatgataatgaataatggaggacctactgtatattggatggtcaagaaaagcctttctgaagaggtgatatttcagctgacacccaaaggatgggaaggagccattgatgtaaagagttggcagtggtatgtattggaaggaggggatggaggttacaaacagcttgtaatgagggaggccaatgtagtcggagtgatacgagcaagatgtgagactggagaagcaggcaagggccagatggccttggtggactatggtgctaagttggatttttattctaagagaaatgggaagtgcacggaagggtttcaagttgagttggaacataatcatcatttaaagtttaaaaatatgcctctggccaggcacggtggctcacgcctgtaatcccagcactttgggaggcccaggtgggtagatcacgaggtcaggagttcaagaccagcctggccaacatggtgaaacaccatctctactaaaaatacaaaaattagccgggcatggtggcaggcgcctgcaatcccagctacttgggaggctgaggcaggagaatcgcttgaaactggaaggtggaggttgcagtgagccaaaatcacgccactgcactctagcctgggtaaacagtgtgaaactctgtctcaaaaaaaaaaaaaaaaagaaaagaaaagaaaagaaaatatgcctctaaggctgggcatggtgattcatgcctgtagtcacagcactttgggaggctgaggcaggaggattgcttcagcccaggagtttgagaccagcctggccaacatttcaaaaccacatctctaccaaaaaaaaaaaaacaaaacaaaaaaaaaaaactagccaggtgtggtggtgcacacctgtggtcccagctacttgggaggcttaagtgggaggatcacttgagcctggagggtcgaggctgcagtgagccatgatcgtgccacactgtactccagcctgggcgacagagtgagaccctgtctcaaaaaaaatttttaaaaagacacagcaaaggcctgatctgtgtgactgcggattttttaccagaagacaataaactacataaaaatttaaaaacaaacagtaacaaccacgtgggtgggtgtggaagtcagtagcatgtacgaaaaggtcattaaaggcttctttgaggtcgcaaaagtaaaaagggcctgatccagttcattgtacagattgggaaaaataaagcccagaggagcagtgccaggcccaggatcacacagcaagtcaatagtggcacttggcccagaaaccagggttctcactatcggccttttatactaacggcctcctggtcctgggctggagtctcccgtgaggcccactgggagacccatataccagctccctcctcaatctgagacccaagtattgtaagggcccaaaagaaggatttggatttacataacgccctgaggacagatttctgaaacccttccttcctgtcccctactcacaaatacccactattgtaaaagctatcctgtagcaacaagaccaaaatgtaaacttggcctaaaactggaaagctgtagataggctcttgcacctccaactttctttctctgaatccctctcactccccaggagccacactccctacaactgtgcatccaggcctctcatccccatcccccaaatatacacacatttctctgctctgagaaaggagataggtttgcttgttgcttcctggtatccattccccctttccctgacatccattagaaactcaaagatggctgggcacagtggctcatgcctgtaatcccagcactttgggaggccgaggtgggcggatcatgaggtcaagagatggagaccatcctgccaacatggtgaaaccctgtctctactaaaaatacaaaaattagctgggcgtggtggcatgcgcctgtagtcccagctactcgggaggctgaggcaggaaaatttcttgaatccgggaggtggaggttgcagtgggccgagattgtgccactgcactccagcctggcgacagagcgagactccgcctcaaacaaaaaaaaaaaggggaactcaaagatttgctgaatgaatgaatgaatgtgcaaatgaatgaatgaatgaatatctctaattcctttcttaaaactcttcattggctttccattgcacttaatttaagaaccataattctgaggccgggcacggtggctcacgcctgtaatcccagcactttgggaggctgaggcgggtggatcgcttgaggtcaggagttcaagatcaggctcagggcttagacatcccaatgataactgagactttgagctttgactcagagggaagcacaagggcgagttccagatgacaccctaaggctcatcttagggtggaagtctaaagtggtacagcactttgggagagtaacttgacagcatctgttaaatttgaaatgtacatacctatcaatcttgcagttgacttctctgaaaactattctgtatatccaaggatagtcactgtagcattcattgtggcagctaacatggtgaagccctgtctctactgaaaatacaaaaattagctgggcctggtggcatgcttgcaatcctagctactcgggaggctgaggcatgagaatcacttgaacccaggaggcacaggttgcagtgagctgagatcgtgccactgtactccagcctgggtgacagagcgagactctgtctcaaaagaaacaaaaagaaagcatatactccaagcattatctattacagttgccttagtcatttacttcacactcctacgggcctcagaatactttgcaacaatctttactatctccgacggagtgtacagctcaacattctttatagccacagggttttatagacttcacatcatcattggctcaactttcctgctgccttctacgccaactaccatttcactttattcaccgttttggatttgaagctgctgcttgatactgacattttgtagatgtagtatggctatgccggtacgtttctgcctattgaagaagatcatgttcttttagtattaaacagtacagttgacttccaatcaattagtttatatataggaatcttgtgtagcctgcagtggggttgtggggagcaaggcagaagcagccactccagagaggatttacatttatttcttccaggcatctgagagatcatttcagagtgggtcgctttttatattaatttctcagcttcgagattcccagccatgcaggtgatgcaaatgtgaacgccagactcatggagggtaggcatgtggtttcaaattctcaggagattattttccctcttacccaaagaccaggtcaagatggacacatcctttttgtctcccttcgctagtaggtgttggtttttcccctagtttgttctttcactgtgggtgtagcccttcaagggtcctagatttatcaagggtctcagttgcaacctctaatttcatataagcccaaagcttcaactccccaaatgtttctttaaaaacacaagctattgcagattcagttgtgccttttaaaggatgtttgttgtttttatttccagcatctccttgggttgtgtagcaggaagttcctgatattgtcagaaaaggaagtccaactcagtatttagtacaactgtctgtttacttgtctattttctccatgagtgtcaagctctgggaggtcaggaactaaggctgactcatctctgggacaaaacaccaggcccaagatctggcacaaagtaaatgctcagtgcgtttgttgatactgaacctccacttggtcacttctaatgatggggagctcactttctcccaaggtggcctctttcctttagagagggtgtgtgacctgagtgaccaccgggctaatgggggacagcctgcccctcatttatgtacaaccttcccaatacttagcttgtccatccagattctgcagaagggggctcaaggcctagacatcccagtaataactgagactttgagctttgactcagagggaagcacacgggccagttccagatgacaccctaaggctcatcttagggtggaagtctaaagtggtacagcattttgggagagtaatttgacagcatctgttaaatttgaaatgtacatacctatcaatcttgcagttcacttctctgaaactattctgtatatccaaggatagtcactgtagcattatttgtggcagcaaacaattgaaaaccacccaaatgtctgtcaataagaataactaaataaattctctaaagtcaagtcatacagtggaaaactgtgagccttttatttttgtttttttgagacagggtctcactctgttgcccagactagactgcagtggcgccatcacggcttactgcagcttcaaccttctgggctcaaaggatcttcccaccttagcctcccaagtagctgggactacaggtgcacactaccacacttggctaattactttttatttttgtagagatgaggtctcactatattgcccaggctggtctcaaactcctgggctcaagagatcctccaacctaggcctcccaaagtgttgggattacatgcgtgagccaccacacctggcctatgtttttttttggtttttttttttgagatggagtctcgctcttgtcacccaggctggagtgctgtggcgcgattccggctcattgcaatctctgcctcccgggttcaagtgattctcctgcctcagcctcctgagtagctgggattgcaggcgcctgccaccacgcccagctaatttttttacttttagtagagatggggtttcgctatgttggccagtcttgtctcaaactcctgacttcaggtgatccagctgcctcagcctcccaaagtgctgggattacaggtgtgagccactatgcccggcatgttttttttttttaataaggtagatctatgtatattgacataagtggaattccaagacatgttgctgtgagtctgtaagacagagtgtataatatcaagaaaacagacaaacctataagcagtgtaaattggtacatcatggaggctatttggtaatatcagtcaccttttttttttttttttttgagatggagtcttgctctgtcacccaggctggagtgcagtggcgtgatcttggctcactttaacctccactcccgggttcaagcaattctcctgcctcagcctcccgagtagctgggaatataggtgtgtgccaccacggccagctaatttttgtatttttaatagagaaggggtttcgccatgttggccaggctggtcatgaactcctgacctcaggtgatccatctgccttggcctcccaaagtgctgggattataggtgtgagtcaccgtgcccagcctaagtcaacttttaaaatgctatttaaacttttaaaataacctcaactgactaatccccactaatagatatttatattacaaataaatatgcaaaataatgggtaaaaatattaattgccacattgtaataacaaaatattggaaacaaactttttctccttatgagactggatatatagagtgcatctatttgatgggatactatgcaggtttgaaatagaatgaggctgctctccatatcgatatggaaaggtctgcaagatagagtatgaagtgatgaaaaaacaaggtgcagaatagtgtctctatgtttatgaaaaatacatgtattatatgttggattttattattttattattaattttttgagacagcatctcacatctcactctgtcacccaggctggagtgcagtggtgcaatcatggctcactgcagcctcaacctcctgggctcaagcaatcctcccacctgagcctcctgagtagctgggaccacagggctacaccaccacgcccagctaatttttgtatgttttgtaacaacagggtttcaccatgttgcccaggctggtcttgaactcctgggctcaagtgatgctctcgcttcagcctcccaaagtgctaggattacaggcatgagccaacatgctcactctgcattggatttgaaatgcatagaattcctctggaaggaatcacagggaactggaattggttacctccaggaaggagaccaataattgggaactgggaagggaaggacacctgcaaacgctgtactccctattgaagctttgtaattttgaactatttccttacaattaagtaaggaagtaaaaaatgttaaaccataattgtaaaactggaagcaaaacaagctgtacaaaacactttctatatgtacatacacatgttgtgtagaaaaagaaaagaaggatacacttcagactggtggcagtggcagaagttttctgggactggataacaaagggtggtcaagggtgaccttgactttatctttttgttgttgttggggttttttgtttgtttgtccgttttgagacggggtcttgctctgtctccaggctggagtgcagtggcagaatctcggctcactgcaacctccgcttcccaggttcaagcgattcccctacctcagcctcccaagtagctgggactacaggcgtgtgccactaagcccggctaaattttttcattttagtagagatagagtttcaccatgttggccaggatggtcttgatctcctgacctcctgatccacccgcctcagcctcccaaagtgctgggattacaggcgtgagccaccgcgcccggcctgttgttgttgttgttgttgttgttgttttttaacatacagggtcttgctttgctttttttgtttgtttgctttggggttttgtgtttgtttgttttggagttttttgtttatttgttttgagatgtcatccaggctgcagtacagtggtgcaatcatggctcactgcagcctgaaccttccaggctccagcaatcctcctacctcagcctctggaatagctgggactacaaatgcatgtcatcacatgtcgcttttatttttatttttattttttgtagagacaggggtctcatcatgttgctcaggctggtcttgaattcctgggctcaagcagtcttcctgcctcagcctcccatagagctgggatcacaggtatgaaccaccatgcctagccttgcttagatttttatataatctttctgttaattgttactttttttttttgagatggcgtctagctctgttgcccaggctggagtgcagtggcacgatctcggctcgttgcaacctctgcctcctgggttcaagtgattctcctgcctcagcctcccgagtagctgagatcacaggcacctgccactacacccagctaatatttgtatttttagtagagatggggttttgccatgttggccaggcagctggctggtttcaaactcctgacctcaagtgatttgcccacctcggcctcccaaactgctgggattacaggcgtgagccacagtgcccagcctgttacatcatttaaaatccattttaatctttaaaagtaggcttcaggtggatggaacacaaccacagcctggcaaaggaatgaggctgactctcctccttctgagggaagtattcatgttgtgctctttgtcccactgccttccccaaggacagcctggctcagtggaggcaccggggctactcctggcatcattccagagagcctctcttgtcacctcttacccacttggctccctgtcaccagtgttctgggctgggctgagaagcagcacagattaactattgggttgtatctccagaagccccatcgatgtcaggttgggcagagccagcccaggaaacatggaacatctgcctctggcctctcacctctttgttctcctacgaagcccggcttttttttctttttttgagacggagtctgctctgtcacccaggctggagtgcagtggcgcggtctcagctcactgcaagctccgcctcccaggttcaccccattctcctgcttcagcctcccgagtagctgggactacaggcgcccgccaccatgcccagctaattttttgtatttttagtagagatggggtttcactgtgttagccaggctggtctcgatctcctgacctcgtgatccacccgcctcagcctcccaaagtgctgggattacaggtgtgagccaccgtgcccggcttgccctttttttttttttttatagattttggcagttacttggaatattctttccctttgatactccactacctttttcctcataccccaatttatatttctgtctcatctcattcagtggagaggaggcatctgaaaaacccatcaactagatgtgcagggatttaatgttcctacattaattgtattttaggaggcatctaaaaaggacgatgcttaactatgaggaaacacacaataatgatggaattcctagcaccggtggagaagagatcctgaggcagaaaggccttgctatcactcttcagtcatgttgataggcaatgctacaaagggcttaagaacgtggcactgaggctgggcactgtggctcatgcctgtaatcctaacactttgggaggcccaggcaggaggattgcttgagcccaggagctcaagaccaacataggcaatatagggagaccccgtctctatacacaacaacagcaacaaaaattagacaggcatggtggtgcatgcatgtagtcccagctaatggggaggcagaggtggaaggattgcttgagcccaggaggttgaggcttcagtgagctgtgattgcaccaccgcactccagcctgggcaacagagtgagacctcatcttaaaaaaaaaaaaaaaaggccaggcccagtggctcacgcctgtaatcccagcactttgggaggccaatgtgggcagatcacaaggtcaggagattgagaccatcctggctaacatggtgaaaccccgtctctactaaaaatacaaaaaaattagctgggtgtggcggcgtgcacctgtagtcccagctgctgcagaggctgagacaggagaatggcatgaacccagggccaagaccgcaccactgcactccagcctgggtgacagagcaggactccgtctcaaaaaaaaaaaaaaaaaaaagaatgtgggcactggagccaggctgcaggctgacagattcgtatctgtcacttagcagctgttgaacctttgacaaataacctgtctgtgcctcagtttccaaatctgcaagatggagataagagtagctcctttataggactgttgtgaggctgtaatgagatattacatgaaaagcctgtagtcccagctactcaagaggctgaggctggagtaccacttgagcccaggagttcaagtccagcctgggcaacatagtgagaccctcatctctaattaaagaaaaaaaaagagatttaatctctctgtaatccccatcactttgggagtctgagacaattggatctctggagcctgggagtttgagaccagcctgggcaacatggtgaaaccccatctctactaaaaatacaaaaattagccgggcatggtggcttatgcccatagtcccatatactcagcaggctgaggaacaaagaattgctcgggcccaggaggcagaggttgcagtgagccgagattgcacttgggtaacacagcaagactctttctcaaaaaaaaaaaaaaaaaaaaaaaaaaaaatcggccgggcgcggtggctcacacctgtaatcccagcactttgggaggccgaggcaggcggatcacgaggtcaggagattgagaccatcctggctaacatggtgaaaccccgtttctactaaaaatgccaaaaaaaattagcaggtcgtggtggcggccggcgcctgcagtcccagctactccggaggctgaggcagaatggcgtgaacccgagaggcggagcttgcagtgagccgagatcgcgccactgcactccagcctgggcgacagagcgagactccgtctcaaaaaaaaaaaaaaaaaaaatcaaagggcctccgatctatgccaaccactccttaagatccctttggttctcaccaatctctcatatcccaccactgcctttcagtggccttcactcaccaaacctgttactcttcatcaaaaactgtacccctaggccctttccctcaggcctcgctttttttctttttttcctctcacctctccatcctgtccctgttaccctgttatctcagttccatatctcaaaagcctagaaaggcagacaagacagagctctccttaaaaagtgatgggcaggccagctgtggtggcttacgcctataatcctagcactttgggagatcaaggcaggaagatcacttgagaccaggaattgggcaacatagtgagacgcggtctgtacacaaaattttaaaaattagctgggcatggaggtgtgtgctgtagtcccagctactcaggaggctgaggcaggaagattgcttgagcccaggagttcgaggctgcagtgagccacgattacaccactgcactctagcctgggtgtcagagaccccatctctaaaaaataaaaaaagtgaaggccaggtgcagtggctcacacccgtaatcccagcacttcaggaggccaaagtgggaggactgcttgagcccaggaattcaagaccagcctgagcaacaaagagagagagagagagagagagagagagagagagagagagagagagagaaaggaagggagggagggggagagagagagagagagaaagaaaaataaattagccaggcatggtggcacaggcttggataattttttaaaaactatttgtatagaaggggtcccactatgttgtccaggctggtcttgaattcctggcctcaaacaatcctcctaccttgacttcccaaagttctgggattacaggcgtgaagcctgcgtgtatcgattttctattgctgtgtaacaaacaaaacctccacagacctaggggctcatgacagcacctgtttattagctcacaattctctaagtcagaagtctaggcacatctgggttctctgcttgggatcccacaagtctgaaatcaaggtgttggccaggtgtgtcctcatatggaggcttgactagagaaagatcaacttccaagctccctctggatgttggaagaattcattttcttgtgaccatattagcaaggccctgttttctcactttctgttggcaggggaccactctcaactctcagcttgtagaggtccctcttgggtcctcctcttgtggccctctccacacatagcatttggtccttcatgggagcaccagctgctggaaaaaatgattctgttaggtaaaaatactatacatttttgaaacatgcaccaattatttagctctgtgattgtgggcaatttcttcaagcagcctgagcctcaatttccttatttgtaaagctgggaaaacaacgatgcccatcttggagggttacaggcacatagaaaaacaatcaataaatataagctgctgtttacatttgttctttttttaaaaatttttaaattttatttatttatttattttgagacagagtcttgctctgtcatccaggctggagtgcagtggcgtgatctcggctcactacaacctctgcctcccaggttcaagtgattgtcctgcctcagcctcccaagtagctgggattacaggtgcacaccaccacgcccagctaatttttgtgtttttagtagagacgggttttcaccatgttggccaggctagtctcgaactcctgaccccagggcatccactgcctcccaaagtgctgggattccaggtttgagccaccacaccaagcctacattagttctaacgaatagacagggtctagacacagtgagattagatgagtgagggacagggttccctacatggagaaaactgcaagagccaaatcttggaagcaggaaagctggtggtttatttgtgaagggtgtgtgtgtgcgtgtgtacagagaacgctgaaagagtaggtgaacacagttttgcttatccctccagtcagaatttactggatgcttactgtgtacccagtaccatgaaagggtgcccggccagcagtgtgaattcagcctggaagtgggagggagccaaggaagagctctgagttggagagggaagtggtctaagcttcgggaaatttatctgctcctagtagagtggttgactcagcaggagagaacccccttctcttctgcaccctctcctccctagcctcaaagcctgctaaggacccagttcccaagcagagacccaggagggagttgcagaatctggccctgtctggacaagacagacagggtgcgactccagatgccagttcctttctttctgctcctgaatggccccaaagctatcccttctcaccacaatggtcaaggagggatacagcaatttctcttttaaatgttacacatagggctgggcacggtggcctctaatcccagcacttcaggaggccgaggtaggaggattgcttgagcccaggagttggagaccagcctgggcaacataggaagacccctgtctctaaaaaaaaaattagaaaaataaagttctaaatgtgggaaatcatgctgggcactcaactacagcagctcacttgggtacttgtccacactcacaaatatagccctgggaccccaaagtcactgtcccaccctcacaccatgggcagatggactcaaactaagccaggcttttggctttctgccacttgcctcttctctctgaagtgaatcctgtcctgatcatcacctccttgctgacagggccattaagcgcagttcacacaaacaaaccacgatgccttgaggttgagactgggaggtatgttaagggagcatggagccagccattctgcagatggggaaactgaggcaaagaaaaaggaagtgacttgcccaggctcaggcagtgagcccaggacagaccaagactgaaatctgacaatcagcccagggtttatacacacacacacacacacacacacacacacacaccccacaatttgagttacgctcaaattcagacatcgtgggttgaacaacaaagctttttttttttttttttttttttttttttgccagagtcttgctctgttgcccaggctggagtgcagtggtgcgatctcagcttactgcaacctccacctcttgggttcaagtgattcgcctgcctcagcctcccgagtagctgggattaaaagcacctgccatcactcctggctaatttttgtatttttagtttcaccatgttggccaagctggtcttgaactcctgagctcaagttgtgtgccggccttagcctcccaaagtgctggcattacaggtgtaagccaccacacctgggccacaacaaagctttttgaatagaagttcttggaatatggcctcttgttaatgtgtaggcccatctgttgggggaatttggggattatgcctgctctagctggctttaccaattaaatgttttcccctctctgtctcagttttttcaccggtaagataggaagaatttattatctatgtcagagggattcctctcagcctcactctctatctcaggtcggggggcaggggagggtggggaaggaaaggagtggtgggccagtcctccagctaagcacacagactggcccatacctgcaagtacacacaaggtcccttgagcgacacacccaggctgacacatcactttaagggggcacggaggggggcaggcagtgggagtggcaagccagtggggagcccccaggtgagggcaagcccgaggaatagaagggtggcctctttttttttatttttgtttttgagatggagtcttgctctgttgcacaggctggagttcagtggcgtgatctctgctcactggcaacctctgccgcccggattcaagcaattctcctgcctcagcctcccaagtagctgggaccacaagtgcatgccaccacgcctggctagttttttggtattttttagtagagacagggtttcactatgttggccaggctggtctcgaactcctgacctcaggtgatctgcctggctcggcctcccaaagtgctgggattataggcgtgagccactgcgcccggcctgaagggtggcctcttgacctccagtcctgcagcccatgaaattgggcaggtactcacacctgggcatgggttagatgggcgtgggtccctagtaactctgagtatgagctcatgtgcatgtgtgtatatgtttatatatggatgccttcattgtatgcacagatacccatgattatccatgtgtgtgcataggaatggcaccctctgtctgattggaaatgagactccagagttaccccagcatgatgttcactgccttttttttttttttttttttttttttttgagacagtgtctccctatgttgcctaggctgaagtgcaaccacccaggctcaattgatcctcccacctcagcctcctgagtagctgggtcttcaggtgcaggccaccacacctagctaatttttgtatttttaatagagacaggattttgccatgttggccaggctggtatcgaactcctgggcttaagcaatcctcctgccttggcctcccaaagtgctatgattactggcctgcactgccgcgcccagctctgctgcctctttttacagcctgccggcccagaccagagtctcagaatactaagcccactttctggggccagggtcagtagatagctttgctgctgtatgattctaagcaagtatcttgacctgcatgtgtctcagtgcacctcagtttcctcacctataaaatgaggggtttggatgagttgaggtctgaagcctcctccagcccaggtaataaatctttgtagtggacaggaggaataggtcctaggggtttcaggaggggacttccatgggtacctctgactctacagagaaatggaagactgagatctgacttagcagcctagaaagacttagcagcctagaaatggggttcagctaattctgggaacagagtccggtcacttaaggtaccagagtgtagccaagagcccccttttctgggcttggggaaccagaaccatgtgttcaacagaccattgcctgtacacagggtagagagtgcaggtgtatactcctgaaccagccacccttcttttttttttttttttttttttgagatggagtctcactctgtcgcccaggctggagtgcagtggcacgatctctgctcactgcaagctccgcctccccggttcacgccattctcctgcctcagcctcccgagtagctgggactacaggcgcccgccaccacgcctggctaattttttgtatttttagtagaggcggggtttcaccgtgttagccagaatggtttcaatctcctgacctcgtgatccgcccgcctcagcctcccaaagtgctgggattacaggcgtgagccaccgtgcccagcccccagccacccttcttaagcttcaagctataactactgagcctgtgatgaaagtctactctatgccagacccccacaagctgggtgcgggcagtatagggacaaagactctgcccttgggatgccaaccatccacttgagaagacacatacacatacaatgagtcatcatcacttactgtttatggacaaataaacgtccatcaaggtagccatcaactcgtgggtagggacaaggaaggctacctagaggaagaaagggtgagtagaatctctccctctctctctcttttttaagagacagggtctggctctgtcatccaagctggaatgcagtggcttgatcatagctcattgtaacctaaacccaagtgatcttcttatttcagcctccctaagcagctgggactacaggtgcatggcatctggctaattttctcattttttgcagataagtggtctcgctatattggccaggctggtctcaaactcctggccccaagcaatcctcctgccttggcctcccaaagtgctgggattatggctgtgagccaccacacctggccaagtagaatcttgaagacaggaaagatctggatttcagaaagttctgaagaaggcattccaggcaggggaaacagcttgagcaaaagggtggaggtgggagagtgctgtagagtcaacaaggagtttgactttagcacaagatgcgtgtaggagaaggggaggtgaagctggagagaactggggccggagcatggggggcatgagttctgtgttaggagtgtggggctttaggagccacatcaggttttagaacaaacaagtggcttgacaggagagacgtgttagggattatttaattaaagtcagcaagtaggtctgaaagggtatgaggttagcaggaagtggctgtgatgggcagaggctcagagttgcatggaatgaggacactttgggtataacactccaagggccacaatgccactcccctctccacccctcagccttgggttatttttttctggcttcttcccctgtcgctagggttaaggagtcccttgggggtttcagatgaggctgggatagagttttatcactagagtgccgggcacggtggctcacgcctgtaatcccagcactttgggaggccgaggcaggcagatcacaaggtcaggagaccgagaccatcctggctaacactaaacatacaaaaatacaaaaaatacaaaaaattagccgggcgtggtagcgggcgcctgtagtcccagctactcgggaggctgaggcaggagaatggcgtgaacccggaaggcggagcttgcagtgagccgagatcgtgccactgcactgcagcctgggcaacaagagcgagactccgtctcaaaaaaaaaaaaaaagttttatcactagatcattaacctctggcctaggtcacctccggcctccttttgggctaggtgggcagttctcggaccctcccccaccagccctgctctgctgacctagaacctctggccctggagattctgatatgtgtatttgtggtctcttctcgggcatctcccaggccactgggagagctggggcctagagcgtggggtgggtggaatcctgagggcagagagtgtggaagaatcttacaatggcagctctagagggaagcctggatatgtttgtttgacaaactgagacccagagaggtaacatgacttgaggtcacacagcaagtctagggcacagtcaggactgaaagccaggactctggggaggctaaagcgccctgaggtttagaccatctggttcatgtagagaatggagagggtcagggctgggagctatgggttcaaatcctggctctgccattgactgtacttttgtgacctaagaaagtcacttgagctctctgagtctgtttcctcaactgttaaacgggacaatatctaccttttgggttgttgtgaagataaaaaaacacacccatagcacaggtcgtggcacacagtaagtgtgccaatacatgtcagctagtggtatggtggtgcaatagtaggtgcctaataaatgttgaatgcattgttgaacatgagttcacacgctaacagtgagattgtgagactcagctttcccacgtgtaaatcaggactcataatcagtccctgtcctgccacttctttacagccccggtagcaacatagattaaataaggtatgtaaacgttcaagcgcggagccgtctcaggtcaatgtttactcagcccagggcaattcctctccaagtcctactctgcgaaatttcacgtcagcttcactaacttctctacattcccagatgctccccgggaaccgggggttggggatgtccctcttttctcaagcccgccgagctgaggaaaaacggggtgggaaagcagagtgtgtaaggctgaggaggtgagccagaggggggagggagagcaggaataagggcagtggggagaatgcaggtgcacggacgtggtgtgggtcgagaacagggtccgcatcgggggacttggatataggatgcagtgaaaggatttggggagcagtgggagaggtgagggcgctgcgatccgggaagaatcaggaaaataaggagccggtaggagggagtggagatcctcctcgcggagagctcgccgcggcgcagggctcccagctccccgcagctgcctccccgaacactcaccctcccggttccgagaacgtttcccggcccgagcgcccggcccgcaaaccgggaggggaggggaggggaggggcagggggggatccgcagcccgggattggccgccgccccgccagccggtgacgcgaggcgggcgggcccctttgtgacgtcacaatcagctgtttgaacgttccaatttgtgccgtgagccccgccgcagcggccgcacagactcaaagccccgcgggcgagctcagcagcccggagcgaccgcggccccgccgcctcccccgcgagtcccggcgatgcggcccggcctgtgagcggccggcgaccctgggacgccccgccgcacaactacctcaacgccgtgccgcccccctcccgcccccaggtgagtcccgacccgggtgggcctgggggctcccctgccacggacacgccctgcgccccccgcgcccgggcctttgtctgtctccgccggcggccgccggggccgcgttcccggctcccgattggttgccgcacgcccggtagaccatgacgtcgttctatttgcatatgacattgagacgtcaccaaggccggtaccgcccccacaggctcgggtcgcttgtcctcccgtgacccggtagccgctgtgtcggggctgggccctgggtgagacgctgcaatccaaagggggctgcagggggatcggcgatttcctaggcttatccaggggctggggtcaggcctctgatcccctactttctctttgcaacctgagaaggagtcagacggcgctgctgggcctaggttgagggggtcgtcaggagttcagggctgcatgggactccaggtggttgggacagcaccagatggtggtgggatcccctccctccggctccagactccgcccccagggactaacagaataacatcctcctaatccctgatttgtgtgcagcgccttagctgatgtcactcctagacccaaaatgaagggtcttagaccccagtgcatggaaggggcaacaggcccagagaggaggattagctctctcgaggtcacataaccaattagagtcatgctcactgagtgacagatggattattagccaggggcaaagacataataggggctcagtacaagtggtaagatacacatcctccttccactggggacccgatcttgggctcagccttatcacggtttgataggctcctaggtgtccttactcctggacccttttccagggaatctctggagattggttcaccttttgtggtcctgaccccttctgtcctcactgtaccttgaagtcctagagtccaataaaatcgctgcctcccagctgtttggatcacagagaggtgagtcattggctgcctcggggtgtctccagggctgatgttggggtggagggtggggtgagggttccctctattggccctttaccttcccaacttcctaggtcgtcagctaggaagggcctgacctggcctagtgcagacaattgcaggtgttttgctgctccctcgtcacctctgcccacagagagtataggagaagggataggataaggagagtttctgacttaacaagtggatgggcctagaggctgaaccaggaactccattcctgctgggagtttgctcaaggatgggctgggggtaggggtggcttagggcacaaatgctattctgggcagagctgctgtagttattaaagggaatggttctccctggagcagaactgggaatgtgagaaccaggaagctggcagggctgggaaaggaaatctgggaggctccccaagtggtcaggagagggggcaggcactggctggctggtgactgctttcactcctggctgtcactgacttgctgtgtgacctcaggcagggagcttttcccctgagcctccctcccctaaacctatctgaaatttggggaggcacagtgcaggctctggtacacagtgggtcttcagtaaatgcatgctaaatcttggtgccagtaaccccagacccttttgtagctaggcgaggggtggtgtggctaggtcaaggtctttttcacctccctgtacccctgcatcattgtattcttggggattgtttgctgagtctttcctgactgtgtacactctggactggatgcacagtaacgtgggactaggtctgccctgccactatctagccatgtatttttggatagatttatgtcttctttctgatcatcagattttaaaatgggctgggtgaatatgatggtccctgaaacagctcttaacttctctttcatattccatgaattagtaggttcttggaaggaggatgtgcctcatcaaggcctcgatattcccttccttcaagaggggccaaactttctgggcttttggtaatggagtcactagctccctgtggctacatatgggttgggatacatgaattgtgctgggtggacactagttgggggtggccccaccttcttaatccctgtagatctcccacccccatcccaccagagaagccagcatcttaagcctactgtgagtctgcagatgtggaaatattctcagggtatggaagtgaggtgattctgcagcaagtgtgaaaacatttctagggaatgggggaggtagcaataagcatggcaatactgcaggtggattagcagaaagaggagaaatgccttcagggaagtctggacatgcccccaggaagttctacaggaagtgtggaaacacccttagagaatggtgacaagtgtctcagcagcaaaaccgttgagcatctttagggaacaggtgtggagagtcagtcaggcttcaggtactgggggagtatggccagcagcccccagccaagctctagtcctgaggtaggctggcatggggagggggtagatctagagctaccaccttggtgtttccatttctgcagtagggggcctccctcttcatcttcacccagggaaggattggttaagggcttacctcggtctgggtccaaccctcagtgctcatccttaagggctcctgggaactgacagctccctcccttcatcatcacctcccactgacctgctgtctcactgagcccaagcaacctgatcttcctcctacccctggatgctgcccttgaacaggagcctgggaaaagggggtcagaggggggagggcctgccggcatgccatctttacacttcatatgacagacacaaccgaggtgtgccaaatcacatggtaagatggtagcagttctatgggatttctgctggccagtgcttttcaaaccacacaggctccaggagtggttcttaatctctggggtcaaagattgctgtttaggaaatcatgatgaaaaccaaggtcctttttcccagaaaaatacacatggaccatgacccctggccaccaaattgaaaatatcaaattcagacagacacccagaaaaggcaatagaatatagtgattctgggtgctgcctctggaatctgattgtgtggattcaatcccacctttgtctcctactagctctgagactttgggacagttaacttctctgagcctcaatttcttaactgtaaagtaaggacagtaattatccacttcctgtagttgttgtgaggattacatgaggtaatataggtaaagctgcttagcatagtgcctggaacataaatgttagctatatcattattattattttgagaccaagtttcgctctgtcacccaggctggagtgcagtggcacctcgcaggttccagtgattctcctgcctcagcctgggattacaggcacctgccaccacgcccagctaatttttgtattattagtagagatggggttcaccacgttggccaggctggtcttgaactcctggcctcaagtgattcacccacttctgcctcccaaagtgctgggattacaggcgtgagccactgtgcccggcctagctatattataatgataacaagcagacaatatgggcaatttcctccctgcctggagaactcctatttactcctcagagtgcagcttggatgtccaattctctggagaccttccctggcagagctgtgtcatgtgtcactctatgttcctaaagcaccctgtaataataactaatttattagtttgttgagtgcttaccatatgcccagacagttctaagcactttataagtgtttagctcatttaattcttcctcctccatctttttttctcattcaataactttggtatagctcatttaattcttattagagcctggaggaggatactattattagcttatttaattcttataagagcccggaggaaggtactattatcattgtcttttgacagatgagaaaactaaggcacagataagttaaataactttctaaaatcatacagaagataaaaaaaaaaccctggatttgaatgcagaaagcacatcttcccaaagcgtccgcacacatccccgttgtgtgtacccttctccctgctctgggggtgatatcttctggcctcttccccaggccaggagtggggtgaacctcaatcagtggtggctctcacgtccttctgattcccaggtttttgcactgccatagggcgcccccgtgaggcgcttcgccccccaccatgttccagcgcctctccagcctcttcttcagcaccccctcgccccccgaagaccccgactgcccccgcgccttcgtgtcggaggaggatgaagtggacggctggctcatcattgacctgccgggtgaggcctgggtctgtctcctgggcctgtgaagtcattctaagggcagatggcctagcagcggaggggaagggcgctgctgggggacgggggagtcccccaagcctactggaggtggggtcacggggccccttcccatgaaagccggggctctctcctggcggcccaggagaggcccgcacgtcaggtcccctagggcagcagggcgagacgcctggcccgtgggtgccccggggcgctgcggacgggctgcgggtctgactaacgatgccctttctctccccgcccccttgtccggtgtgtgtgtgtgtgtgtgtgtgtgcctcctcgctgctcccctcctctgcacggctcccatcccgcgccccgtagacagctacgcggctccacccagccccggggccgcccctgcccccgcgggccgccctccgcccgcgccctccttgatggacgagagctggtttgttacccctcccgcctgttttacggcagaggggcctggactcggtcccgcccgcctccagagcagtcccctggaggacctcctcatcgagcaccccagcatgtccgtttacgtcaccggcagcaccatagtgctagagcccgggtccccttccccgctcccggacgcggccctgcctgacggcgacctcagcgaagggtgagcgggccgggggcggagcctggaggcccagggagacggatcttggaggccagggtccaggctaggaggctggggtagtggggccaggagcccgccccgcgctcgagggggtagcggccttgggagggttgcctttgagacaaagtggggggccggtgggcctccgggcgaggctagaagcgggcctgaggacggaggggcggggcttgagagggaggggcgtggccaagaggctggggccggggttggaggcttgaggagcgtggctggagcgcctagggagtgggacttaaacagaaaggcaagggtggaatagggggtgggggtccagtctcccccgaggtccagtttacctgttaagggctagaaccgaggaggcacctccgggttggtacccacaagaagggcgtcgggcaccccaatctgaacagacacagaactgagccgaagcaagggtgggagatggcagcgccctctagaccccccgcccagcttacccggcttgaccgagcctggctctgtcctcacagggaattgacgcccgcccgccgcgagccgcgggccgcgcgccacgccgctcctctcccagcgcgggcggcgctgctggagaaggcgggccaggtgcggcggctgcagcgggcccggcagcgggcagagcgccacgcgctgagcgccaaggcggtgcagcggcagaaccgagcccgcgagagccgtccgcgccggtccaagaaccagagcagcttcatctaccagccgtgccagcgccagttcaactactgagcgtccaccggccgcgccacgaaccccttgccgatcccgatccctgtcgggctcctccgactcctcgggctggacaccgaaacctcccttcttaaagcgtgtgaggttgggtgatagccgttccttccccgacaccctcaatttccccatctctgatcctctaatctgcctctgaacccattcacccttcaccctcactcctggtccccatacccagcatctaatcatccatgccccctactcctggcccctccatcctttcttctctggtccccatccctgtctctccctttcacccttgccctccagtcctctacctctggcctgcccctatttctgaaagcttcttccagtccctgatctggctcattccccaccttcaactcccaccttacatgtctcacactatcccatggttggcattacactcactcctgttcccttattcttcattcccagtaattccctaccaaatggtggggaccctgagcccagctctgaccaggtagagcctgtgcagcctgggctgctgtcattgccctccagtaagggctcagggttttgcttttagtctccccttccttctgccttgggggcggtactctgtggagctgcttaggcctggaaaggtacagtatgtagaagaggactgtgagacgtgagttagagggagaagatggagggaatctagggaacgaggcagcctattggagatgcggacaggacagacacgttgagaagctgcagggagcagggcaccaagggagtgtgcactgtgcttgctcagagaggccaaaccctgctcccaggctgaagcctggagtctgcccccacttcccttttctataatccacccttctgcaggccctgaaatctgaagggcttagttagtaccttgccactctacccccaacacgtcacccgagtagaagctgggcaaggccctaccatcctggccgtctgttcacaagcccaaggtgctagaactagcttaggagacatgcaggccacagggcttctaggcagggaaagggcacacaccctaggtcagcgtgcagagcagtgatgctggaggacacaccatggggtgaagccatcccaaggctgacagctcagtcttcaccttgcctctggccttgtatttcacaccctgctcagtatggctagccagcagtcctgagtaggagtccaggactcccactgtctcaatctgcaaattgttcctatccaggttcagggccttcagggggcctcttttcattttctcccacaggcctctctttctttctaggttgctggggagaaatgggtaccctatgatccccctccccttctcctccagtaaatacctggaagagggaacctgaatccctgggggagacagaaggggcaggggccaccagcctccccttcttgtggtgagactgaattttgggctcagacaccagcaacagcctcttgggatgccctgagttgcttcccatttcctctttctagccgtccttttctagtgtgtgctcactcttcctaggaacttttaagacttcttggtacctatgaacataggtcctcccctcaccccaactctaggtttccaggcctcacagccaagctgaagcttggagaaaactctgcattcccatgagggcaaaggcagctgccctccctgaccctatagccccaggcctcatggggggtatgtggggaagggatggggtatccccatggatgctgggatgaggacagaggaagacctgatggggtctcctattccagggaataagccaaattaacactaaaaacggatcaaagctcccacgccagtccactagggccccagtagttgacagccttgctcctctcccaagttctccttcagaacctagttgcttttattcttccagctaccacttgggcacttcacagccagcctagggtcttcggcacctccaagagctgaatctccctccaacccttcttgcctactcctcactgccagctgggacctaggctcagtcctgtgtggtgcccatgatccttctggtgggggaagagtttaagttatagggcatttggctcaaattttaaaaggccttttgtttacctatatttctggaggctcctgtattctagaacccaatctctcacctgcttggttgcaaggctcatatttttttgtacctttcctatagattctgtagcatttgagtgtggcaatattttaattgtgtatagatttctaagaaccaacactactcagtctcctgctagtctgactcctgaagcatcagcccttgtcatactgtattgactgtgtacgtgcctttcaccttgagcatgcttcaggatttttttttaaaccacagaacttgaatacatgagggaaccagagttcaaagtcctatgcaaccttaggagggggttagagagtctgttttgattgatgttttctgaggccctagaggagtttgtatcaatttgtgagtattaatgtcagtactaccagcactttgccaaaactgtcagagggacccgtttctagagtgagtcccagttacatcaaacagtgacttccagttattccccagtaagtctgagtggttccttcaagctgggtgtctttccagcctttgccagtctagccccagcagggcaccgtgtatgaatgcagtttggtgctgttttagagtatgcctgctccccagccccctgcctggaaccctctgagcaacttgctctgacctataatgtcttaggtgcaacacggaccccaccagagctcttggatacccccctagatccatgtggctttatgtgaggggactgaatgcagacacaccatagcccccttctactactttccctctcgccctgccacctagttccacatggaaccaacaagttgagtgcatccctgttgggtgttttgtgttgagactggctgaaatgaggagactttgaccatgtgacgtgtcaacagactcaaggagacaaccacctcaactgggtcatgtggcatgcctgtgtatgtgtgtaacagaattctgattgttagactgtaatgctattcctctatgggagaaaaaaattaatataaagaaaaacaaataaaaatatatttaaagcacatgatcctttctgcctgagttgagcttaagtatgagaagcatcttgtaatcttaagcacagtagtggcataggatattatgataaagctggccttggttctggtgtgtgtgtcatatgggagaggaagaggggagataagcttactgggaacagagccagacaatggggtctgactcataaatgactactgttagaggatccttacaatgcaagacacatacatgaagacagctgaaatagagatgagaataacagcatgacagaatgaccaaactcatccttgtggtctcaggcactgggttagagcaagggcaagtagccactggaggggaaaggatgaagtctaatcctgggggagatgcagcagaaggctgaagcccaggctgagacaaggccagggccccaagcatcagagtctcctcaagttgcaggtagggtggggcagaagcagctggctttggagactacacacattttgaagaaggacagccagagtgaaatgtagtggacatctctgaaatatacagcacaaaatgacccctttaatttgggagctgctctgtctaaccacagaactaaaggtggaaacctgacctaaactggactagatttttttttttttgagacggagtttcactcattgcccaggctggagtgcaatagcgcaatctcggctcaccgcaacctccgcctactgggttctagcgattctcctgcctcagcctccccagtagctgggattacacgtgccaccatgcccagctaattttgtatttttagtagagacagggtttctccatgttggtcaggctggtctcggactcccaacctcaggtgatccacccgcctaggccctccaaagtgctgggattacaggtgtaagccaccatgcccggccctggactagattcttgatgctggcacaatcttacaggccagtttgggcttacctcctgcaaggaggagatgtcagcacaattgttttggagcaatccaccatgcaaatggaggagcagatatgtgacatggtgaaaaagtgccatctcagctgctgacagcttcctgtccctagaaaatcctgggtggccattgatctctaagttggttttgttatttgcatcaaaagaaatctgagcaatatatatcaaaatacctggcacagtgctgaacagggctagtttcttcaaagccaagaatgaggtgagggagcaagtatgtacattttcctcaacttgccaggcgggcatctcaggttcaatgaggactagataggaattccatccacaaggctgtgtctgcttagttaaggtccaaagaaagagctgatcacccaaaaatcccttaccaataacataactttatgttctatgacaatgacatttatttaacacgttatttcacattgtacaaatccttagattctctttattcactggtccatttctacaacaaatacatccaaaacactatataataaaattatttacaacatttccaaatgagaagattgcttttgcccccactactgctattcacacacagtacttccacggcacaatacatcattaggagatctaaaaatgctcaccctgtactctaggctgcttaggaaatgtgaaaactagtaacatttataatggcattagctcctttcaatacaagacaacattttagaaaccttgaacttcaactcgcaacaccaaaagggctcaacagtcctgctttccccattgcactttatgaaacaggttgcagggactaggaaaagggccacattattaaaattactaactgtacagaaattgatttaaaaaagtcacagctcaaaattgctctttgtaaaagtcacacacatttccaagtatcaagtcgcagtcctgcttgtttacttggattttcttcgcttggattgcaccgcactggttatgtctgtgggggaaagaaaggacatgttcagtggaagtaactctttacagcagtgccctttagacagtccacaacaagcagggcagacctaaggggagccctactcaactcagaatctgtctaaggggtgctctgaatggagagagtcacaggctttgcttgatgacttacgtgggaagagggtgtggtcctgcattgggcagaattggaatgtgacagaggtggtggcgatgaagcacactgactagagaaagtgcagggtggagagagcctttgtagctgggcaattcacccactgtttccctcaccagttctcatcataaaacgaagtgtaatagacagactgacaatgcttttggtgagaaatcaacgagtaatgccataagcaaatgagtaaattctgttagaatgcaaaaaaaaacctgccttgggatcccttttggagccaagctattgtttcacagtaaggaaccatttttgtcatgctatagtcaaggtctaaacaacatgaccatgggccttggtcagtgagggtctactatggcccagccagttatatcaagattgtggaaggctgggcgtggtggctcacgcctgtaatcccagcattttgggaggccgaggtgggcggattgcctgaggtgaggagtttgagactagtttggccaacatggcgaaaccccatctctactaaaaatacacgaaaaactagccgggcgtggtggcgtgtgccttaatcccagctactcaggaggctgaggcaggggaattgcttgaactacggaggtgaaggttccagtaagccgatatcccaccactgtactgtagcctggagacagcgagactccgtctcaaaaaaaaaaaaaaaaaaaaagactgtggatacatacagtcatgaatgcaattcagaataagcaacggcctgctctgagcccaagtgagcctgaaggcttcatggaggaggtgggaactgagtgatttacacacagaatgacagtgacatacagggaaatgactatgttttgattcctttagtttctcttgtactatcagtgttttaacttaatcttatgccagacttaaactgtgtttcttaaaaacgttttggccaggtgtgatggctcacccctgtaatcccaacactttggaagactgacgcaggaagctcacttgagcccagaagttttgaggccagcctgggcaagatggtgagaacccatctctacaaaaagaaaagaattagctgggtgtggtggcacatgcctgtagtcccagctactcaggagaccaagtgggaggatcacttgagcccaggagttcatggctgaaggagttcaaggctgaagtgagctatgttcatgccactgtactccagcctgggtgacagagaccccatctctatttaaaaaaaaaaaaaaaattctacacaaagttatggcagagtacagtgaatagcctgaagctctccaaaggtaaacacttctttagaatctcatattgacttcaaaaggtcacctttatttcatattctggttttaatatgaaaataatgttctaaaattacttctcatcaaggagaaaaaaaatgcttctaatatatcaatacaaaagatgaatcagatttacccatttctggtaactaggctgaattttctgatactgcatgttaggttgtattcaaggcaaattttcctttgtcttttgtatcataatattttgtgaacccagactctaataaatatgtagattgtaaggaaaaatttcactactctgttagctaaggtgactgctaagaagtgaggcctaggccaggcgtggtggctcatgcttgtaatcccagcactttgggagtctgaggcgggtggatcacctgaggtcaagagttcaagagcagcctgaccaacgtggagaaaccccatctctactaaataaagaaaattagccaggtgtggtggtgcatgcctgtaatcccagttactcgggaggctaaggcaggagaattgcttgagcctgggaggtggaggttgtggtgagccgagattgcgccattgcactccagcttgggcaacaagattgagactccgtctcaaaaaaaataaaaaaataaaaagaagtgcggtctagatgaatttccaagaggtgcccagtacagtaatttcattcaagcctctgttggtggaaatttcagtatgtttgtcttctcaaaggtcatgtttttttttgtgccatgtggtagaatcagtctttctgatttactcattagtcttttactaatcagaagacagttaatctgccaggatgttaataatggtgttctttattttaattcatgtaaattaaagagtctcacacagcccacataactccctaaaatcaactcttcaggtccaaatctcaagcgttattttcactgcagcaaatttgtcatttgcagtaaaaataggcagggtttttgtcttgacagtgttcatcctcagcaaaacattcattaactaggtcaactttggaagcttttcccttgttgtgatatgaaggatcaagtggtatgtctgagaaacatatgtggctgggaaaagaagtgggtagtggggtgtgggggagaagcaacctcaggctccccctccttccttgcttgttcccatttgtcactgctccgaagcacccaatgaactggtaggttgcctctgagcgtgaatcaatgagtggggtcaggaataaacaaatgacttgtgctagaaactgcaaaaaaacccacaaacacaccattaaaaaccctcatcttttggatactgtggttggtggggagaaggatgtaaactttcatacttccatgaggaaaaaaataaattttaaactgagtttgaagtctctatcaccttccctggataaatccagtcaatctgagacatagagcaaacctcagactcaacatgtctaaaaccaaacttgggattttcacctccaacagtgaggtcctttgccactgttccccatcatgtctgaaaaaaatctgtctgaaaaaaacatcttttgatgagtttttttgttttggtagttgattttctactccctccaaaatgttaccacttttactactctaatgaataggcaaatcacctttttttttttttgagatggagtcttgcaaattacttttttttttgagacagtctcggattgtcgcccaggctggagtgcagtggtgcgatctgaactcactgcaacctccaccccctgggttcaagcaattctcctgcctcagcctccctagtagctgggattacaggcatgcaccaccacgcccagctaatggttgtatttttagtagagatggggtttggccatgttggccaggctgatctcaaattcctcacctcaactgatctgcccgcctcagcctcccagaacgttaggattacagaagtgagccactgagcctggccacaaattactttaaggtaagaaattctaggtaagtgatgtagaggctaatgatccagtcagggtgtacctcagactgtgattggcacgctgttcctaaaggctgcctggcctgactgtgaacctaccttcagttttttaactatcagggattttacaaaattagtgtctcttaacagatagacaaatagttcaaactctagcagtgtagtcaaatcatttatatccatgtcttagaaccaactgggtggtaaagaactgggtcaataatagtcttttaagtgactgtccaactatgtcactgggggaacatttaaatttataacctaataaagggatttgtttttcagcctggttgcctcattttgaccttaagcaaatttgaccaaatctacagtacaaggctctacttaatcctctagtatgtgacctctaccatccaaggagctttagaaatggactttgaccttgctcacatcattgtgcctttcactgtactatttctatccgagacgtctaagtaattgtaaaaaattctggaaatcggcgagatgcggtggctcacacctgtaatcccagaactttgattagcagaggtcggcagatcacttgaggtcaggagttcaagaccagcctggccaacaaggcgaaaccccatctcttctaaaaatacaaaaattagccgggagtggtggtgcatgcctgtagtcccagctattcgggaggctgagccaggagaatcacttgaacccaggaggcagaggttgcagtgagttcagatcgcaccactgcactccagcctgggcgacaatccgagactgtctcaaaaaaaaaagtaatttgcaagactccatctcaaaaaaaaaaaaaggtgatttgcctattcattagagtagtaaaagtggtaacattttggagggagctctccagcctgggtgacagagcaagactctgtctcaaaacaaacaaaaacattctggaaattttccttcacaatttgcatggttggtttcaaaatgaagctactacagtttcaggtggttactcttcagggttttctcccacgacattataaatgtatgttcacttgcatatctacagtaatacttctgttttaattcagtatatctttataccctgtgtttttttagacagtttcttcactggctgtgggtagggtggggctatcacctactttgttgtcagagggacacccagggctgctgataattacagattgctctgaactttccttaaattaacatattttcctggttccaaacttaaagctttgaacttcatatttttaactaccttttaaaaaaataattacctttttcccagttgaaaatataacaacaactattctaaatggaggagtaaataatgataaagcaagctagaaaaatcatttgtgtttttgtggcaaattcatcatgtcaggaaggaaaactactcatttgcatgtttgtaaacaacacatctgatcaggtgcaattttaaaaagtgatttgtggtagctaatttttgtgtaattataagtgacccaaccaacaaaaacaatggaccaaagaatgaccaaaaaccatgtgggccttcctggacttgcccagaaatcatccatcccacctgctctgatctggcagtctggcaggccttggccagcatgatgtaagcaaactcggctctcgcagcaggagcatgattaatgtcactggttctccaacaatacaaacagcaacacttttaattacaaactgctcatagtgtttctcagcttcagagattttcatgaaaaacacagaatgtctctgattttgtttgcatatgatatatatgaccaaactcttattaaatgcaaaaagaagccctctttccccctcaaaactttacacagtgctgattctgcaggaagatacttcactcatatttcaggtacccagcactgcatatgtccccacatttgaggtgcatccattttagaaaccagcttgatatttggtgatcacattctgggtatgggtttaaatacaatcacagtaaattattttataacttggttcacatttttggatacaatatacaggccaaaaatatgcataattattctttaatttggctccaagagctttaatactgaaaaaccaaaagagctacagtactcatttctgatttaaaaggtaactgtgatactacaatatatattttttggtttttgtcccacgttcctggctcacagctcctataactcttgtaatttcctaagtgagccatcttttgttaaaatatttggccttttgcccatggttcctgaaacagctctgaggttgagttgatcacaaatggccaactcttttatcaatcatgcctatgtaatgaagccccactaaaaacccaaaagggacctatctccccttccccttcttcctctatacaaaaaaaaaaaaaaaaaaaaaaaaaaaaacaacccgcaaaacccacaaaaggactgaattcaggggcttcccagaaggtgaacgagaacacatctacctgctaagagggtggtgcaccaactccacagggatggaagcttctacacttgggatccatccagaccttgccctatgtatctcttcatctggctgttcatttctatcctttaaaagtggtccccaacctttttggcatggactgggggttgcgggggagacagtttcaggatgaaactgttccacctcagattatcaggcattagttagattcttataaggactacacaacctagatctctcgcatgcacagtttacagtagggttcacactcctatgagaatctaatgtcacctctgatttgacaggagatggagctcaggcagtaatgctcgcttgcccaccactcacctcctgctgtgcggcccagttcctaacaggccacagaccactaccaaccagtccatggcccggggattggggaccactgctttaaaatatcagggcatagtggctcacgcctgtaatcccagcactttgggaggcgaaggtgggaggatcacttgagcccaggagttctagaccagcctgggcaacatggtgagtcctgtttctacaaaaaataaagaatttagctagccatggtcatatgtgcctgcagtctcaattactcaggaggctaaggcaggaggcttgcttgagcccaagagtttgaggctgcagtgagtgatgatagtgccattgcactctagcctgggtgacacagtgagaccctgtctcaaaaaaaaaaaaaaaaaaaaaaaaaaaaagcaaaagaaaaagccggctgggcatggtggctcatgcctgtaatcccagcactttgggaggccgaggcaggtggatcatttgaggttaggagttcgagaccagcctggccaacatggtgaaaccctatctctactaaaaatataaaaattagctgggtgtggtggtacgcgcctgtaatcccagctacttgggaggctgaggcacaagaattgcttgaacctgggaggcggaggttgcaacgagccaagatcacaccattgcactccagcctgggcgatggagtgagactccgtctaaaaataaataaataaataaataaaataaaagtaaaaattaaaaaaaaactttcatatgggaggccaatgtgggaggatcacttgaggctaggagctcaagatcagcctgggcacacagggagaccccatctctacaaaaaaattaaaaaattagccaggcatggtgatgcacacctgtagttccagctacttgggaagctgaggcagaaggatcatttaaactcaggagttcaaggttacagtgagccatgatcatgccactgtactctagcctgggtgacacagtaagaacctgtctcaaatgaaaaaaaaaaaaaaaaaaatgccaagcacagtggctcacaccagtaattccagcactttgggaggccgaggcaagtgaatcacttgaggtcaggacttcgagaccagcctggccaacatggtgaaaccccatctctactaaaaaaaatacacacacacccacacacacaaattagccaggaatggtggtgcaagcctctgtaatgccagcaacctgggatgttgaggcataagaattgcttgaacctgggaggtggaggttgcagtgagccgagattgtgccactgcactctggcctgggcgacagagtgagactttgtcacaaaacaaaacaaagcaagaaaaaacgaaagaaaaagctgtataataaactggtaaacatgtttccctgagttctatgagccactctagcaaattaactggacctggttacgaggggttcatggaaactccaatttttagccagctagtcagaagcacaggtaaaacaacctggggcttgcacctggcattggaagtgggcagcagtcttgtgggactgagccctcaaacctgtggatctgatactatctccaggcagatagtgtcagaattgaattggaggacacccagctggtgtctgaggcagaactgatgacttgcttgatgtgtggggaaaaaaacaccttacatcttgtgtcagaagcgtgttgtgagagtatagcaggagaaactgagtctgtttttctactcatacacagtaacttaaccagagacagttagagaatgatggcctgaggtcttgcgactgatgcggatatctatacatgactgtgattccagggacaggccagagctatgccattctttagggagacacttagcacccctccatgcaagatcacaaagcctgagagtcattatggcctcttctaagccaactgctaagcctcagagcaaggatgtgccaggctttccaacatcaccactgccacggtgggacaatgttcagtttaagtgtacaggcttattccccatccccaacaccccttaaaaacaggttctagctttccatctcttcttggctggtagttctctacagagcggttctagtttgagcatctcttcttaactgtcccagttgcttcttagattctttctggtgccctgtaaataaccctttagtaccttgaggctctgggctgaggtcaaggttccaaaaatctggtgtgtgacatctctaaaggccaataccttttccccgctttaaaggtaattacataccatattctatagcctagaagatcttactcttttgggaaagtgaaaggctacaagaacatgcagaactgaggggaagcagattttcccatagaactctaggcatgttcccttttatgctttaagtgtagtacttcaatatactgaaaagtgtactcccttccaaactagtttctgcctagagatgattcccagagaggaggaatgaagttattggcttcatatctccacctaaaatgaggatacctaagagaccctgactgtggtgtatacactattcctggaaaagaaagaaggcctctctcacctttgccccttaactctccagcaggctgagtatggtgatggtactttgtacacctcaattttaactgtatatgacctctggcctattcccagaggctcttgtgaggcatcgtgacattcttgcctagagacataacctgccaacagcagctgagtcctcagatccgtgtctagtgtctagtgtgggtgcaccagaatctgcctggtctttaggctggcatcccaatgatacttgaccgtttctcagcagtcctgctgataatcaggaactcagccaggatcccagctcttaccttacccaaactgaactactcaagctcagcacatttcctaagagaatgatctggtcactgcctcctcattcttcaggtctcagcttaaatgtcatgtcatttttttctagaaagccttctctgacctggcagaagagcaaggtatctcagctatatgctcttatagtgccatgtaattttgctatcatagcatttaacatttaacacagagtattagaattcgtctttcaatgtggtaaagacagagactttttttttttttttgagatggagtctcactctgttgcccaggctggaacacaatgacgcgatcttggctcactgcaacctccgcctcctggattcaagcaattctcctgcctcagtctcctgaatagctgggattacaggcgcccaccaccacacccagctaatttttgtattttaagtagagagggggtttcaccatgttggtcaggctggtctcgaactcctgacctcaggtgatttacctgcctcggcctcccaaagtgctgggattacaggcgtgagccactgcacgtggctgaggctctgtcttttcactattataacctcagggcctgacatgtagtaaatatttaatacatatttgatagatggttattcatttgataattactgattggtacatctctgtatttggcaccatactaggcaccagagatacagtagttcgcaaaatcagacataatctcctgccctaaccaagtatacatactaattacctatgtcacaaactggcatagttatagctgtggtattatgaagaagaacctggtgctgtgattccccatagcagtgacaactgagctaagataagtaggaagggtgggacgttaaggagaagagaggtgggcagagagaagagcactccctgcagtagctgcaacatatgcacaggcttgtgatcagaggaatgaggacggcatgtccgacttgctaagggaagtgggatgaggctgggagatgacagggccgagaccacacagaagcttgtggggtaggttgaagcttttggactttaatcctaattacaatggtaaatcattgaagggttttaagctagtgggtagtagtgaagatggaaaagggccacctgagataaaatgggcagttttttgtgacgagtttgatataagggtgagggagagaggtatcaaggaggacttgtctaatggatagatggtggtgccatttattgagatggggtacaatggcagaggacctcactgttggaggtgaaaaatcacaagtttggttttagatatgttgagtctgaggttccagtaaggatgtgcatgcagttgtctaagatctctaggggtctgtactagaaatagaaatacaaatttacaagtcatctgtgaaaggctgttactaaagaagaggggcatgactgagatccattagggagaaaatacgaatttgaagagaaaaggtgactcaggatcaaagtctgaggaaggtcaccatctaatggctgggaagggagactgaggaggagcagctggagaggtggtagcagaagacaacagagagttcttggtcacagaacccaagggaaaagttaatttaaaaaggagatagtagtcaacagagaacactcacagggtaaggttcttaagaaggtcagaggagatgggatcaaaggcatagatggagaaactggccttagacttgaggaaggacagctgctctattatagaaagcacaaaggaggatactggtagatttatttcttggtagtgggaagctgagggaattctattttctctgtgaagaggtcagggtctctaccaagagagagggggagaaagtgtggaccagaggtttaaaaagaatagagtgggaaagatagttgaccatggaaacatggaaagatagctgggccatattcaggacctatctgaagtgggtgatcatgaatttaaagtggaatcagctgggcgtggtggctcagcctgtaatcccagcactttaggaagctgagatgggcagatcacttgaggttaggagttcgagaccagcctggccaacatgatgaatccctgtctctactaaaaatagaaacattagccaggtgaggtggcacgcacctgtaatcccagctactcaggacgctgaggcaggagaatcacttgaacctgggaggcggaggttacagtaagctgagatcacgccactgcactccagcctgggcaacagaatgagactccatctcaaaaaaaaaaaaaaagtggactcaaggccaggtgtggtggctcatgcctgcaattccagctttggaaggctgaggcaggagaattacttgagcccaggaattcaaggctgcagtgagctgtgattgtgccactgcactccagcccaggcaataaagtgagaccctgtttcaaaaaaacaaacaaacaaaaaccaacaacaacaacaaaaaaacccaaaacccaaaaaccagtggaataaatctgccctgttatgttcttttttccagcagtgcttgttgctcttgagtacacacacagaaaacatacagttaaatgaacaaataaaggaaggaccaaacaggtagtagaagacaaagacacttgacagacttcaggaacagaagcaatgatgaaggacaaagtcttctactgctgtggtaagaactctattcctctatttgacccacaaatagcacccacatcccactgctaacctttagtagagctggaggctgaagcaggtcgagaagatcgtttacgatgtccattttccacactttcagaggccacagttggctcttcagttcgggagtttcttcggcctgggattttggacttttcaactatctctttgggctcactgctgacagagggaagcaaaaagtttccaagcaggtgagggaaccaggccacacaaaaaacgggctcttcagatagtttcattcgtaaagtaggagactaagaactatatagttattctggagagaaagcagttcaacctggggtaataagcactattgccttctatgttactgggggtttaaaagtgagtctagcttattacattagtaaaaataaaatagtaaagcataatgttggtgaaattgtagaaaaactggtaaaagacataaaaaaattggaacaaaactcccctaattcctcacccattttcttttcttttcttttttttttttttccagacagagtgtcactctgtcgcccaggctggagtgcagtggcgctgtctcagctcactgcgacccctgcctcctgggttcaggcaattcacctgcctcagcctcccgagtagctgggactacagccatgtgacaccacgccctgctaatttttgtctttttagtagagatgggggtttcaccacactggccaggatggtcttaaactcctgacctcaagtgatccacccacctcggcctcccaaagtgctgggattacaggcgtgagccattgcaccaggcccctcacccattttcctaaggtaatagttcccttcaaaaattaaaacattttggattttgtaattttttagaatcatgaaaatggtctttaagatgtctgaaaattgctattaactcaaaatagtatataaacctaggaaattattaacatatattggcatttactaatgatcccggtagagtcagataacagcatattagaagccacagtatggggataattcacaatacactgctaggtatattgattgtccacaccccaacccccttttcttagtatatgaagatttaaaattggtaatattcactgttattgaggatacaggaacaaaaacatttacatacactcctaactggagtgtaaattgtataacccagtggttcttaaaaggaggcaattttgcttcttaggggacatttagcaacatctggagacatttttgattgtcacaacttggggagaggggtgctaccggaatcttttgggtacaggccagggatgccactaaacgtaagccccacacaacaaacagttatctggccccaaaggtcaataatgttgaggctgagaaactctggtgtaacccttgactcagcaatcccacttctaggtgcctaaggaaacaaatctttttacagagctccacacataaggaagttaaaacattttatttgtactagtgaaaacagaagacctaaatacctaacgatagtagattagttagctaaatcatggcacatccatatggagtcatgaaaaatcatgttgtagattatttaatgacaaaacgatttatgacacattaccaagtgggaaaaacttaccaacacaatgaacagtataattccattttcattgttgtatgtgttgagtatatatgtaactacatatgaataaatatgagctatatacacataaatcttttgttgttgttgtttgtttttgagatggagtcttgctctgtgccccaggctggagtgcagtggcaggatctcagcaaagtgcaaactctgcctcctgtgttcaagcaattctcctgtctcagcctcctgagtagctgggattacaggcatgcgccaccacgcctggctaatttttgtatttttagtaaagatggggtttcaccatgttggccaggctggtctcgaactcctgacctcaaatgatccacctgccttggcctcccaaagtgctgggattacaggtgtgagccacaacgcccagccctatacacataaatctgacacaatatatttgggtgcacactgtgtgaaaaagactagaagcagatgaactaaaatatatgtacagtgaatattgttgagttgtaggaatactagtttactggtgagttattttcttctttgtaattctctgatctgaatttctggttttctttaataattttttacactttcatggttcaaaaacgcatgttaaaatgatcagaaaaaaaattctttagaaaattaaatttgcttgcaagacatgtaacaaataaaaataatgcaacaaaacaaaacaaaacaaaacaaaacaaaacaaaacaatactggtcaaaaggctgcctcttctgggaagtcttccatgatctcatttcccaagtagagctgtctcttttgtctcttgggttcacagtctttatctggcattctagagcacccatcagattgtacatcgtgttctattttaatgttttgtgtcttcaactagactgtgaacctcttaaggacacagaccataacctgactgtcaactatccctacccttccactgttcactcctgccagaggaccctttgctagtagcaccgtggttgggaactgggacacaccattcactcccatagctttatgtataacagccgcccgacacccaaccataagccaaggtaagtcaaggagaggtgaggctggagctggggtggaattacaagtcagggggatttatacctcctttgagaggtggtgaagatggctttctggctaggagctcagaaaatggtcaaagcttctgaggaaagaaagttctttttttaaaaaaaatttttgttttttttttgagacaggatgtcactctgtcccccaggctggggtgtgggtagtgcaatcatggctcattgcagccctgacctcccaggctcaagtgatcctcccaccttagcctcctgagtagctgggactacaggcaagtgccaccatgaccagctaattttttattaattttttattttttatttttttttcatagagacagggtctccctatgttgcccaggctgggcaactcctaagctcaagcaatcctccctccttggtctcccaaaatgctggggttacaggcatgagccactgtacctggctagatgattcctaatgaaagtgcctctttctcctggcaaaacaaaagccacagcaagactatcctgttttttatggtcaatgctcaggtatctctggaaacaaacaccccaaatgtatttttggtctgattagcttctttctctagacaaatagctggtgcatgcttgagaaatgcagatgaattcaaacattagcccaatccaaataaaatcagacaggcagagtggtatagtaggagtagcaatgaatttggaatgagatgaacaggggtgaagtcttagctatgcatttattgactatgctatttaatgctctatgttctagacttttttttttttttttttaagatagagtcttactctgttgctcatgttggagtgcagtgagcacgaccatggctcactgcaacctcgacctccctgggctcaggtgatcctcccacctcagcctcctaagtagctgggactacaggcacataccactatgcccagctaattttttgtatagacagggtttcactatgttacccaggctggtctcaaacacctgggctcaagccatctgcctacctcggcctcccagagtgttgggagtacaggtgtgagccactgagcccggccgttctagactcttttttcttttcttttcttttagacagaatttcactctgtcgcccaggctggggtgcagtggcatgatctcggctcactgcaacctccgcctcccaggtttaagtgactctcctgcctcagcctcccaagtagctgggattataggcatgcgccaccatgcctggctaatttttgtagttttagtagagacggggtcttaccattttggccagggtggtatcgaactcctgacctcaaatgatctgcctgcctcggcctcccaaagtgctgggattacaggcgtgagccactgcacccagcctcattctagattcttgatctataaatcccatcttgtctgttgcaatacataggttaaatatcagggctctgaagtcagaaggcttgggtttgaatctaaccttcaccatttactaattctgtgaccttgggcaatttagttaacctttctgaactttagatttctcatctataagacagaatttactttcctaatagatactgtgaaaattagatgagataacacatctagggcacttgtagctcaatctattaaggatgcatggcatggaacaacattcaaataaatggtggctattaacctcctcacagggatgatatgaagattaaatgaaaaaaatattgtgaaagtgtcttatgaagttgctgtacaattatgagaagttctttaaaatattatccagtgcattcctacactaaaagagacaagactgtgtgtggtggctcacacctgtaatcccagaggctgagacgggtggatcacttgaggtcaggagttcaagaccagcctggccaatgtggtgaaaccccgtctctactaaaaatacaaaaattagctaggtgtggtggtacatacctgtaatcccagctacttgtgaggctgaggcaggagaattgcatcaaccccagaggtggaggttgcagtgtgccgagatcgtgcaactgcacaccagcctgggtgatagagcaagactctgtctccaaaaaaaggcatgacttttggaaaatggtaatattcctctccacagagctaatgaagttgaagccatagatgtatgtcattttgtagggttatgtggagcagcacagtgtaacagaaaaaagcataggttttgggtcagatcctgcctggctttctccttcttttgctttcagggtcaaacaactgttctttagaagacagctgcaaggactattattaatattaatatcaatggtaacaacagctcccatatattgaacatttactatttcctcattatgcagaacatgttatctcactcagctttgaaaacaaccataaaaggtagaaacttggcctccagcttttattaagagaaatgttacctctgagggattaggactcatgacagctctctacgttagcagtaaaaacagactggtgcaagagtgaaggaaaaggacaaggtgaagagaggtttaaagactgagacagctgatacctttcaaagaggcttatgctgtgttcatgctacgtctgcagaaatgatcatcttacctttgtccagagactatggcagcatttacctccagctctgcaaaaaaatataaaggatagaaatgaaatgtgggagctgccacagagagaagctaggagtctacaagaattctctatgccctatttaggctaaagtgtccctgtgcccagcaggattctcaccctacatggtatggagacaaagctggcacagatacaacttggtttgtttgggacataagacacttggtctatttttatttctactccacatggtgaaataatctgtttggattaatagaactaagttcacccttccttgttcatatttcatccagttacaaccaggttagcaaaataagtctcttcctctcatgtggaagagaccgttttcattttaaaacatctccatccaccttgttgccacttttttaaaaaaagcaatcttcaaatatgtcttgaacatctattaaggatgcattcttctccaaaggacttcctcactgagttttagagggcacagtgctttgctttcagatattgcctttacaccccattctattcctttctttctcaacctcccagcaatgccctccaagcaaggaaaatcttagtaatctgtctagcagggttttccatcaatgagcacactctgggtttaccatgcacttcttcctcagcaccagcagaaaaacatttgctttctctattatgtgcctttaggtagttccatcttttccaaaagccttccctgatgtaccagatagcagtgatctatcctgcctctggcctcccacagccctattcctgttcccccattgagggaagtcagcacctcattactcagtgtacatgtctaacctactctactaatcacatggtaaccttaaaggcaatgaagtcagagtgcctggttcaaaattttgacttcaatgcttattagccatgtgaccttgggtaaattatctgacatctctgtgctcaatcccttacctaaaaaatgggaataatcacattacccacttcaaagttaaggagatgaaataatgcatgtagaaattttagtatggcacctgacacttagtcataactcaatgttattagctattattattgctatgaagatcagattgatgcagcctttcatgtaaggaggttggactactctgcctttaatgcaaggtgctagtagaagggaatctttgatgggaggctgaggcagaggaatcccttgaacccaggaggcagagacttcagtgaaccgagatcatgccactgcactccagcctggtgacagagcaagactctgtcccaaaaaaaaaaaaaaaaaaaaaaaaaaaaggaagggaatctttgcttctcattgctgtttagcctcctgtatttgtacccacaaagcctgaaaacccatccacaaaaaatagataccaattcactgagtctctgctactttgctggcttggctggaacgtataaactcaggtaatgtgtgctcaaaaatgaaaatgactcaagtcaaaagaagtgctcaccctcattgttttttatttttttgagacagggtctcactctgtcccccaggctggggtgcagtggcactcactgcaacccccacctccagggttcaagcgattctcctgccacagcctcccgagtagctgggagtataggcacgcggtaccaggccagctaatttttgtatttttagtagaaacagggtttcgccatgttggccaggcttgtcttgaactcctggcctcaagtgatctgcccgccttggcctcccaaagtcctgagattacaggcatgagccaccgcacctggcctatttttattttttgggggatggtctcactctgtctcccaggctggagtgcaatgggatcacagctcactgcagcctcaacctccttggggtcaggtgatcctcctacctcagcctcccaagtagtatgcatgccaagcccaactaatttttaaaaattttttgtagagatggggttttactatgttgcccaaggtagtcttgaacccctcggctcaatcaatcctcccatctcagcctcctaaagtgctggggttagaggcatgaaccattacacccggcctagtttgctcttcttttttttttgagacagagttttgctcttgttgcccagggtggagttcaatggcgcaatctccggctcaccgcaacctctgcgtcccaggttcaagcgattctcctgcctcagcctcccaagtagctgggattacaggcatgtgccacgacagccagctaattttgtatttgtagtttggggtttctccatgttggtctgggtggtctcaaactcccaacctcaggtgatctgaccgcctcggcctcccaaagtgctgggattacaggtgtgagccaccgcgcctggcctagtttgctcttttaaaacaagaaaaagtttgatgcttttgagaatcttaacactatcactgctgattcacaagtagagatcaagaaggtttgatgaaggtaatcagtggctctgagggatgttaaggataaggagattcatttacgccagacttccaaatggaagaggattcttcagccaattactgtgagaagggggaaaaatgatatggtaaatcctattttctagagtagggttggggcaggaaatggaattccctttccctttagagttactccttttcttaccaaaaatgagttttgctgtatgacccctcctttaaataacgtgctccattcctacccttctcaaatatccaacacaatgtcaggtatcatgtgggcaattggcagcaaagaaagaatctgggtggctgggccggaagtagtggctcatgcctgtaatcccagcactttgggaggacgaggcaggtggatcatgaggtcaggagatcgagaccatcctggctaacatggtgaaaccctgtctctacaaaatatacaaaaaattagccaggctggtggcgggcacctatagtcccagctacttgggaggctgaggcaggagaatggtgtgaacccaggaggcagagcttgcagtgagccgagattgcgccactgcactccagcctgcgtgacaaagcaaactccatctcaaaaaaaaaaaaagaaaaacaaaaagaaaaaaagactctaggtggctgaaatgttttttgctcgcacactattttcagaggcctgattttattcagagtgtgcagtagaaagtcctatcagtcacacaggatgtagcattctgaagtaggttttaaaataatcacaaactataccttacttttactggctcagattcacaaaattaagcatggctactattgctttttcttactaactttgtcaagtgtgtgaattgtagtttcaatgagattcttacctctgtggggaccagtcatacttttttttttttaactcctcaatgatctacagtgacaaagaatcaggcgaaactaaactgtaccatatctgcgatatttatctgcctccatagtctataaaggcaaaacaagggctgtggctgccatcatcctcatgtattctgagctgaccctgatcccacagcagttatttgtcagattaccatgggatcctacttccagaaatatcatcccttgtgctatttacaatatattggtcatggggagaaacttaatgccacccagagacgactgaaatgactctgcctccctggaggaatggctatcacattgtggcagagactcaatgaacaagactccactactgtcataataaaattacaaagtgcgttaatgcttgccagcccagtaagtcaccatatgccagctattcagctgccaaccatgggtgccagggtcacagaacagggaaaactctgcaacagaaacccatggctgggtggcagacagacaatgggcacggaattgcccttcttgagttccctagctgacactatgaatgcatgagagagcaagctggtcggggggaaaataatctcaagtagaactgcacaagctttgtcactcaaccaaagtctgctctgaagcaaacagataaaatagttcctgtcacttcctggcataagaacacacgacattgaggacagcagtagttccttcacatgtaacccatcccactccaagaagtttttccaaagtacgccttacctggtctggcaacagaggcctgcagtgctgtggttgaagtttcctttgagactaaattctgcgacggggctaaggcaaggaaaaaaaaattacagaccttttactttcttttctaaacaaaaagaaagcattaacctaatcaagggctaagtaactgctgaaacaatgtactcttagagggcagtactcaaaattggcctcgaaattacaagtacattttaaaacttactacaaaaattaattaccataacacccagtaccaatgactaccatttaggggtataggctcttcctttttgtatgtataataataaggggaagagatggctataagaacatagcactcacattttctgcttcttggggtcaggtcctgaccactacttgaaaaagccccaaagcatatcttagtaggcaacccaaaccatagaggtacaattataccattcccctcagcatttaaaaaatctagcctcactccctaaagactatactctatgagagtggaaatggtcacataattttgtacttttctatagcacttagcaaaagtgatgggcataaagcaggcattcaattcatacataataaataaataaatttgatatgttatttacttatctaacaaatagttgcaaagaacttactaggggcaaggcactgtgccaggtaccctgagagaccaaactatatcctcttgcacatcaggaactcagtctagtattaaagataagatatatacatgtagtgcacttgagtgcactctgatgtcatatgaaggagtcacaaagtataaaatactacaaaagtccaaagcaagagttagcaattctaggttgagaaatctgaaggtacattaaagggagaaacatcagaatcaggcttcaaaggacacagagaacttaggcccttaaggaatggaataaaatatgtaatgccctctagaagggaaccatcctggaagataaagattatggcatggatatgccacagtcacatcttgacatctcagtctaaaatcctagataaactctgcaacaacatgttttactctcttgtggaaactgaattttgtatatttccctccctgcttagcaaagcagtaaattatgcatttgtgtttaagaatttattttggatgcttatctgataaagcttaaaactatatcttaacttctacttttaactttagtgttcatttctcaaatttccttttctttttctcctgagacagagccttgctctgttgcccaggctgtagtgcaatggcaggatctcggttcaccacaacctccgcctcctgggctcaagcaatcctcccacctcagccttctgagtagctgggaccacaggtgcatgccaccatgcccagctaatttttacatattttttttgtagagacagggtttcgcctcattgcccggcatggtctcaaactcctgggctcaagtgatccaccagcctcggcctctcaacatgctgagattacaggcatgagccaccgtgcctggccaatttctcatattttcaaagtaaaagcacagaagccccttgaaaaagaacagaaacaatcacttataagcaaagtgagtgttcttaactaaaattgagaacttttcccaagtgctggttcatctcctcaaggcccacatatttctctagtataatatatgatccagataaaaataatttctaattacttcatcatttttctcttgataccagagggaaaagtctcctgaaagaaggagaaatggaaatacttaatagtgaaggatatacttaatttacaccaggttcccttttaattcttagggttcatctacaccaacagaactagaacaatatacaataagcacccagtcttgtgaagactgtctcttgtaagagcagcagacttcttgaaggcctttatcctgcccccatctctctaacactgaggtgaagaggcagagagaaggggaattaacctttccagagctctgcgtgaggcagtgtgttggccacttgacaaatcttctcattgagtcctctctcagaatcctaaattctgggaggtagaatgtacgatctccattttacaagtgaaatacatggcttaggagaggttaaggaacgtatcaactgtaactggtaaccagtgggctagaatttgaactctgatcttaccctgaagtttgtgttctttctgcctctcctcctgggtgcttaccactcagtggtaggcactcgaagcattttagctgcataaataagataggcacttaattagctggcctaggatatcgtaaaggtctttcccagctctagcagtgtgtgactgactccactctggggaaatagagcttcttcacttaagcctcacaggaggaggaacatgtcagggaagggaagaagggaaggaggggcggttgtaaggacacctatgcttccatcattagcccatcttaacagtacataggaaatagcctgaactagatacacaaatggaatgtaccaatcaacaaagagattacatcaaaaagaaactgggaataacaatttttaccatttattgaataataattatatgctaggttctgtgctaagaatgttatatgtactaccttattgaattcttacaactattattgttccatattacaaaggaggaaaccaaagtctggagtggtcaagtaacttgcccaagcccatatagctggtaaatgctggtgttataataccaacccaagcctactggctcttgaccactttgtttctactgtgtccattatcatgaaacccagttttcttccagctctcctctagagtagcccagacaaaaaaagaatggttcctgagatagagtacagtgagaatggggctatgaggacccattgttctgaaatagtcatgagcaaatcttcaccctggtaaagagaatctgcagaagctgctgttcacacttaaggcacagtgttaaatgggaggttcacagtatagactctgaacaaacactgaacgtctttgagcttcaatcttctcacccatacaatggggttaagaatatctgacatagttggtataaagatgatgcaagacaacatatgtaaaaatgcttccttataaattgaaaaacttatataaatgaaaggtatcattatttcaggaactctttgttttgagagccttagctctctgttttgtttttttcagacagagtctcgctctgttgcccaggctggagtgcagtggcatgatctcagctcactgcaacctctgctcccaggttcaagctattctcatgcctcagcctcctgagtagctgggattacaggtgtgtgccatcatgcctggctaatttttgaatttttagtacagatgcagtttcaccatgttggccaggctggtctcgaattcctgacctcaactgatccactcacctcggcctcccaaagtgctgggattacaggcgtgagccaccgcacctggcccttagctctctttaatgaatgcaaacttaacatgggatttaaaagcatattttccaacgtactttcaataaataaaactactgctattgccatttagcccattctctttcctccaagtaaaaaaggagtcatgctttctcttgtgggattaggtcatcaaaaaactgacacaaagagatgatgaagccccaagtacatacctatgctgggtagaagttctggatgggatcccaccttctcctccactaggccacccgcaagtgactcagatgctatgccaccatgattgctttttgtggtcggtacggcggagatgagctcggagggtaccagagtggttactatcgagcgtacactggtggggagagcaccgccaggtaagctgggtcctgctgaggcagtgcccgggcccacagggctagaggtcatttttagcagagtgggtgctgggggcgttggggttttactgtccagctctgtggataactgctctgttcccatgagccccggagctgtggtgtctagcccttggccttcagtctctccatctgcaccatattgttcttcccctttctcaagagagcctgtaactttcttacatgccttggtcaacaaaatttggccaattttgtccacttttcctttgcccttactagacgagactgggcttcgccggttgccagaggaccctggactattggtcaaaaggggagaaaccattgtggttgactgtgaagagggaagagtgttctgatctgctgaggtgttcacctgagggctagcctcatctggattcaattctttcacttgctgcacagggggatgagaagggacaactggagaagacgtacaaggaggggaaggaagctgaacaggggtggctcgtgagctaaggaccaaaggtcgacctgtctggatgtttggagcaggactactggagagggcattaggcggtacaggagcagaagaaaattttatgttctgaggtatgtgtaaagggccaacaactgcaacagagggaggcatcaggccagagttggttgtcagtggggctgcaggaattgtgcttggctgtgatcctttcataacctgaattattgaggatgaattgataaagacaggtgtaatgaactgaggccgggcattagactgagcagctgactgtccctcagaaaccataaccttgctacccgcattgggcattgtgacaactgttgacatcaatgcagactgcaagtgagttggcaaagctgctgatgtgttagctgaagttgtgatgggattggaagtgacaaatacagttatttgatttgggggcaagggagtggaaatggaggaagagctaacaggtcttgacattactggagggatgcttggtgcaacgttagaactgacctcactcaattcgggatgcacaagggatgaacacagctcattactgtgaggtaagtttagggaattagaaggttctttagaagaagacagatcctgcagtgtgggaatgacagatgcttttttgaggtcctccccagaaactactggaggtgttacttccagatctgtaagcccagggggtttaattgtcacattgggagctccagagttgtcaagaagttgacttaacgatgttggtgcttccctcatagcaggagacaccaaatttttgttctcttcgacactgggaagtttgttaggatccgaaggctgcccatcctttttggactgatcttcagggacaaccattttaacttcttgggcagggactgcttttagttcaatgtttacctgttccttcctactctgggaattctggcaatcactgtcctgaggcacattcaagctctccttgttatcctcaacaacacccccaactgcagccacagacacagtagaattctgaggattcagcccactgttgttaggaaagctcccaggtacagggggattggccagaggagtgggactgaccaatacatttctcggcaactccacattctgcaatagggctgcatttgtctgagaggccagagtaagtttaggggcttttgaattttgcctcccagggcttggagtggttttcctactggacccaggactagacctgcgactgttgcttggacttgcccgttttgttgctccagaattagactgctttccagaattcactaccacagaatctaatttgtgagtttgtggggtagcaaaattggaaggattcatggtaagatttgaaggtgcttgcccgatggccttcaaagttgttggatttaggccttgttgatcaaagcccctgtttaaatttggcctaggaggtaaaggaatattaatctgtggagggaagagtcctgctatggaggcattgagtctttctggtgacagactgatttctgaaggttctgtgctgggagggcggttgttgggtgtctgaggataatagggtctggggctggctctgtttggtgttttgggcctagatgtctgggttggcgcagccacatttgggaagtggtggccgtgagagctgggcagggaatttacagggggttgctggggagttgcaccttgagttgctgaaaggggcgatggtccaggttttggccctgtcatcattaactgattctggggaagtactacatgtgaaggcatgttgtttgggcctcctgggacagatggtgcttcactgccacttgcttcagggagtgaggccatctccgccagtggcgagctggaaggattctgcgggctctcctgatagaccattttccttgaattgcttcccaagggagtattcacaggcattggcattctttgtttatcaggtgatggtggcacggaggcaggtccttgcagactgaccatgacaggcacactgccactctgttgcatgggcattctctgggagtcggggttcagggggccccttggaggatggacattttgagagactggaagcctaactgatttgggatcctgctgcatcatgagcatcatcatcatttgttgctgctgctgctgctgctgctgagactgtggctgactgggaggtggtggctgctgctgctgaggcagttgtggctgtggctgctgctgtggtggctgtggtgggggtgccacatgctgcatgagttgaggaggcatctgctgaagtggcctctgttcaactggttgagaaggataacctaaaacaagccccccaaattagggaagttagatttttcagcaagaaaatgttgctacctttagagtatagccaagcaatactcatctaggtggcacagactatgcacaaacagctcaggcatgcccactcctggggcagggggcagcccctcattacttgacataagcaaaaggggcacagtgcttaaggaagcaaaaagcaaagcatcaaaaaacctggagctcctcggtgtgtaggatctgaatgagccatgactgtactaagagcctgattttctgtgctatgcactgaaaatggctgtgtctataccagccaaacattcagatgaaatgagaaaaactccatcaacatcaagtgcctggccacccaagattcaggtctcatgtagtcataatcaatatttcaatgtacttgtgaatgaagtaaagcatttaggattcacttcttctgttagcacaggaataatttttttaagatgtggttttgttgaaaataacagcactgaagacagcctttttattctttcaacagaagtaaaatataaaattctaggattcagttccttaagaaagaggaatttaaaattattccaattcattggctccatacactacgccgcatccttcaggcttaatcctttgggggaaaccgactgaattaaaattgcccttcaggtgtaaatcagtttaataaacagtaggagctaatggaagctgatatacacattgaaaataaaattagggcattgaagtttttatggatattaatttgcacttactttcttacatgcaaatctctatttggagaaatattttccatgaatccacagctggagaataagtaaggcagaagcatagccctcaggaataaaaaataattttgggaaaagaactctgaaggacaatgtcttctagatatgcagagggcaacatctcaaattattctctttttttgtgaagattttacttggcattttagaaccaaaaccttacaatcagaaaagataaaaagatacgcaaaccaagaataacggtggttctgtgggaaaaagtgggcatacagctgggcatatatgggatacaattccagttccacaaactagatttattccattgttgcatgaagagtacattagggaggttttaagaaggtgtaggaataagaacaactggctctggcagtcaaaagaaatgctgactcaacattttcatagagcagctaccaaattttgtgggtcagactcagcactcaattaatgtcttctggccaaagatttccatggtatcaatgaatacaatgtgtagaatccagttttgaagatttttaaaaaaatccttttttattttaggcccgagtaacttcttcacctttataaagccaataacatggcatttctatggttcaactgtcctttcgactacatagtcaaatacagtgggttcctatttttcacattcagtctggggttcccacattaagaaatttgtaattgctacaaaagcctgttgatgtcagggttatgacatggatgccttttatctttaaaatcagcccaccagacagtaaataccaaagaggacagcatagacaatatagcagcctctcaaaagtaacagttaagggcatggctgctacagagtccagaagctggaggcagcagtccaaaaggcactaatgataagacagattggggctgacgtgacagaatggtgaagagggaaagccaggacacacatagtgcccataacacaatcacaaactgaatttattactcagggaatgcaaactcctatgcctttaggggccaggcaggtagtagagaatagaagtggactggtataagacagcaggagtcctgtcaacagtgccaaactgcagagcagatgccctatttaaaggcatttaaactcggacttttgtttaagacactgcatagcaactcaaaaccattataggccaaattcagcctgcaggcccccagtttgcagaaagaaggcaataaatgtatacaaagacccctgggattcttataagaagagttcagatgtgtctgaggcaagcaggcatgttcctgctctcaatgccttctggacatactccccaaagactgatgacctcccagtctcagctatgctgctgcatctcactgacgggaagtgtgatatgcccaaataatttgtaataaataacacaaagtattgatatcatgatggatttagctttttgtttggattcaattttaaaatacataaattaggggtagattaaaggttactcctaaaataatgtcgctctcattttcatgccaaaaagaagttgaaataactagtgaggaagaaacaaaacataccctctgtacacacaggggagagtggcctaagtgtgaagggttgtgtatcttcaaccgtgtcataggggaataaagttacaagtcattgctcaggccaagataaccaggtatagagatattgtggcagctggccttggttctataatatctaggtttgaatgaattaattttaggagcttttccatctttgacataatttttcaacatttaaaggatagtattattttataatcagagaggatacaacaaagggggcttccaatattggtcctatttattataaattattaacctatgtggtagatacatgggtgtctcttttattctttatatcttctttatattttaaagactcattaatgaaacttctataaaaaagatcatcttgttttaaaccctggtagttccctgctttgagaagccccaggaagaaacgctgcaggaaaggcaggcaagcaggattagagtgaaatcatctctccatttaatcttatcctgttctgatgccaactagaatcttgacattgacaagaataaagaggcacttcacatttcatggtttttttttttttttttgagacagggtcccaggctggagtgcagtggcatgatcatggctcactgcaacttcgacttcctgggctcaggtgatgctcccacctcagcctcctgagtagctgggactataggtgcgtgtcaccacacctggctaatttttaaaaaatttttagtagagacaaggtttcaccatgttgcccaggctggtcttgaacacttgcgctcaagcgatctgctcatcttggcctcccaaagtgctgtgattacaggtggatgagccatcatgcccaaccacatttcagtccgattttatgaggacttaaaataacaaagacaaatttgaatagaatgtgtgtgtgtatgtgccttcaaaagttatatttgaaatttttacttaatatcaaggcaaagcttccaaataccagacacattaaatcactgaagtagactagttagcagataaaataaaatactattgtttccttgaagacatggaagccttgtaatgccacatgcacatgtaataagtatataatctagctaacattttatcacctggtggccggtttgaaaattctggcagtttagggcctgagttatccaagttaattccttgttctccaggcaacggtggctgatcagcctcttccagaccagctgggcgagtatctggggtgctaaaaaaaaaaaaaaaaaaaaaagtgacatattttagaataagttgtatagaaaatacacaaaactagcttaacccttcccctatttctgaagaactaaaatgtttgcattaccattattcatctctctctagtctagataaaatattaaatattggcataaaaataatctggcaatttcattaaatgttaaaatccatttaatctaacagcactgtatttactcagaatgctttccacaaattcctggtgcaataattttcatgtaatcacccattccttagctgttttaagacctgatcataggactatcaatgttacaaggtactgttcctgtgaaaccacactatcttcaatgtagcgatcaaattcaactagggggtctgattgtttcttttttgtggatataacagtgggggctcaattcataacaccttgcaaaaggttgtataggttggctgatggtattcagagaacaaagaaagattgagaccaccaccacaaagattttgctgcagaatgagaatttgcagacatctctatttgctttgagatgcctttgcttttacctgggtgtagcttaaaatttttagtaaggaagaaaaaaatgaagaaattgtagctactaacacccacattctcaaagaacaagactggtcacgggcctcattttgtttgtaatctcagtactaattgtacttttcttttctatctttagtttccctttgccctgattttgttcacccacttttaggtagtgttttgtctcattatactctgtacagtttcataagccacaaaaatccactttaaaagcctcccagcaaatggaaatttagaacctgaagcagatcgtcagcacatccagacctataacaatttgctccttgtaagacttctctctcactttaaattacaggcaagaattcgtggtaacctttactttcagaaaattgtagagataagaaatctcagatatctggtccagccccatcatgttatgaatgagaaaactaaggcccaaaaaggtgtatgaaacaggcccaagattccacagtgaagtagtggtagagctggaagcaggtacttttcctgtaaatccactgtctccctttcctgggagtcctgatgctgtgtaaggtccctttcacaatttgtagacctaagtaaccaatttccctaagggctggtgaagatggcaaaaaatacacactagaggcaactgaataaccttgcaattttactcccagactaccgagagaataaaatatttattaaataattattcccataggttgatgctagtaaagaatttaactgagaaagagctatcagaaaaattagataattaactttgaattcaggaaaatataggttatcattaataatacaccatgattagcttttaaagcataagattcaagaagaggcaagtgagcatgatataatacagtacaaagaatgttgtgggaaggctgggataaaggtagttggtttaattttgaatatttaagctggttgaaataaagtttcttgattctttttctataattctaacaatttatttcaattaacctgttttacattcattagccattatttcctcatttattatttttttatgattaaaggcacaaaatatagctcagtgaatattccttctggaaacattttatcaaacccagaaacacaaattaatacttagcttcaggaaatgaaatataaattgttaattgcctttcctgctatgatcttgcaaaataactcacctggagaacgtttactgaaagggtaactgatttaaaaggtccaatcatcttagcgtggggttttaagcttctagggatgataaagagcctttaaaggaaaggcacctgtgcaaaaaaaccatttctatttgagagacagcagtagttttaatttccaaaacacatttggcctctctggttccccaatagccatcataagcctaaagtcagtgctttgtggagttgccatatggtagcactggttacttttcaggctctgattgccaaaaccccccgacactgtaaaattaagagatataccagccaattgcaacatatgaatcttgtttggatccttatttgaacaaattgtaagaaaaaaatttgagataatcagggaagtttgaacactggatatgagagtactaaggaagtattagttttctaggtgtgctaacaatattgtgcgggcatattaaaaagtgtccttatcttttagagacacacactgaaatatttacccagcgaatttgctttgaaatactcaaaagggtaatggaagagagtacagatgaaggcaagacagactatgagttgataattattgaagcagggggatttcattatactattctagttttatattctgtaaaattttccatcaaaaaagttatccacacagaaaacaaatgaataaaatttgaggcaaaaccatcacaacctactttagatcttgctgactatttttcttcttccgagggggtttcttcttcttcggtttatttgcgttggtattattttgcttattgtttaccccaaaatggcctgcagatatgtcactctgcaataagttgaccaacaatgggctcgttagcgtgacatccttattgactgggaagcctggattttgaccacaggacatctgatttccattgggagctccactgaaaggtgcattgaaagacatcccatggcctgagaagtggtttcccgaggcactgtttccctgcatggcctgcacatgaggggggaccatgttggtttgttgaatgctaacatcaggcatcatctgagataaactgacatcgttatttgctgtagtagcaggatcaccatgctgctgggccatgtgtgggctgggccctggtggccgcaggacctgtccctgaatgcccataacctgagatggactgttgttcacaggcccttgctggggcagcatctgtcctgacatctgtcccgtaaactgcaccatatttccttgcatgtttggagttggtcccctcattatctgggctggtcccggcatgacattggactggttctgagtgttaaactgctgcttattcccctgcatttgattggtcataatctgctctatcattgggttctgttggagcaaaacctgcccctgaggccccatcatctggttatgtggcgccatcatttgtgggccctgctgggaaagcatctgcttgggtggggtcatcctttggggcgagggcccaagattttggctcggggggttcaccatcatctggccctgtggcataagctgggcccttgaaaggatcatagggttctgagggttcaaggttccttgttgctggaccatctggccctgggagggcacgatttgctggtgcatgcccatcagctgagatggtgggccctgctggggctggccttgcatgttgctgaggttcacttgaggaaccccagaagtaccagcctgctgattgttcatgttgccatgaattcccatgaggctgggctgcatcatatttggcggcccgtgggacacctgcatctggttttgaggaggaccagctccttgaccaccttaaaaaaaaaaaaagtcacagtttcagaaataaatatttttatcttattggtattaagatactcaagttacattactcagaaagacatccatcacccttatatccactgaccaacataaatatgctgttgacatacttcctgtgagttttctaaactacaaagatgtggctgtgggataactgcttacattcccaatgaccatataatagagaaggagaaacagtttctacattcccatatggtatcttaaagatttaacgtttcaaagatcaagaaagtttactttctttcagattaaataatgagaaaggcagcatctcactgttttaaaatgacttgtagtggccaggctcgggtggttcatgcctgtaatcccagcactttgggaggctgaggcaggcggattgcttgagcctgggaggtggaggttgaagtgagccaagatcatgccattgcactccagcctggtgacagagtgaaaccccgtctcaaaaaattaaattaaattaaattcaaaaagcactatgggctactgaaataactctgctataagaatgtgaagtgtcggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcaggcgcctgtagtcccagctactcgggaggctgaggcaggagaatggcgtgaacccgggaagcggagcttgcagtgagccgagattgcgccactgcagtccgcagtccagcctgggcgacagagcaagactccgtctcaaaaaaaaaaaaaaaaaaaagaatgtgaagtgtcctcttaggaaaacctcaacaatcatgagaagacatttaaaaatgcttcttggaaaactgtaataataatgactctcaaaagctatgtgtgtgatatgtggatgctgcacttcaaagaaaataacaccaaggacaggtgtcctctgccctgatgtggtaaaaagcagttaatcttgatctggaagctgagcctctggtgggagccaactgactagatgacccatctggaagctgcaaatagaggaataataaaacctcagtgaccctctcctgcgcagtccctggtgaatcatgtggcacatgttttagtcttctcagctatttctaacttagacaaaagttgctacccgccttgctgtagtgcttatttatttactgggtctttgggattttcctatagctacttgcattatctccccgtttaactgaataactttgtagttaattttgtcccttttatttttcactttttttgttgttttgtttttgagacagaatctggctctggtgcaacctcggctcattgcaacctccacctcctgggttcaagtgattttcatgcctcagcctccccagtagctgaaactagaagcgcacaacaacacacccggctaatttttgtattttcagtagagacagggtttcagcatgttggtcaggctggtctcgaactgctgacctcaggtgatccacccgccttggcctcccaaagtgctgggattacaggctgagccaccgcacttggccttatttttcacttttaaatggggactagaaaatcccctacaatgaagttatgaagccagtccatgctccaactatgaaggcagggggcaaactaccttgttcacactatccagacttctcctgaactctaaggaagattttctaaaccagccttataaactcaaagtggaactccatgaccattgtatatgcttgtatacaataaatatactgtgtatattcattcaactgacaattattcattaagtacctgatacatagaaggcactttggtgctgaggtaacatcaataaacaagacagaccaaatccctgcatccttggagcctacagtctaactggcaagagacacaactaacaaacagacaagtattttttcaggaagcagtaaaagctaacaagagaaagtagggtgagagaagagaaagtaagagataagagtagagctactttagataggataaatggggaaaccaaaacatgtacacgtgggccgggcacagtggctcaggcctgtaatcccaccactttagaaggccaaggtgggtggatcacctgaggtcaggagttcgagaccagcctggccaacatggtgacaccccatctctactaaaaattaaaaaaatagcagggcatgtaatcccagctacttgggaagctgaaacagaaaaacgcttgaacctgggaggcagaggccgcagtgagccgagactgcgccactgcactccagcttgggcacaagagcaaaaactccatctcaaaaaaaaaaaaaaacacacacaaagaaaacaaacaaaaaacatgtacatgtggaaggtaccatataaaaacacaaaatagctgtgatagggtacaagaatgagaaatgactttgtcattgttttaaaacatacttttttttttttgagatgaagtctctctctgtcgcccaggctggagtgcagtggcgtgatctcagctcactgcaacaacctctgcctcccaggttcaagtgatcctcccgcctcagcctcttaagtagctgggattacaagcgtccgccaccacacccggctagttttttgtatttttagtagagacagggttttaccacgttggtcaggatggtctcaaactcatgatctcaagtgatccacctgcctcggcctctcaaagtgctgggattacaggcgtgagccaccgcacctggcctgttttaaaacttcctataaaaaaacatgaatttgctgggtacagtggctcatgcctgtaatcccagcactttgggaggccaaggcaggtggatcatgaggtcaggagttcaaagaccagcctggccaacatggtcaaatcccgtctctactaaaaatacaaaaattagccaggcatggtggcgggcacctgtaatcccagctactcaggaggctgaggcagagaattgcttgaacctgggaggtggaggctgcagtgagccgatattgagccactgcactccagcttgagcgacggagcaagactccgtctcaaaaaacaaaacaaaataaaaaaaaaacaaacatgaattcatataactcaggaatgcagttttgcattagcagatagagaaattcaagcagtttgcactacccttctgttaccctgccagaaatagtgtgaactttttttgtaaaagtcagatttttgtctcattccttagtgatttacaattaaagttggagtcacattactaaattaactccaggagggatgggaattcagaaactagttgcactatctcagtccaaactgcttcaatgagaaagggtaagaggattagtcatgtggtccttaagcaaccagaaacatgaagtttgagcttatacattactgctttgcaaatactttttagccattcccctgtatcttatttcctctccaaaatttcttctttttgcagtacactgttggtagtaaacgtgaactgatgaagtttgaaaaatatcacactgtaaaccagaattcagacactcagcataaacaaagcttaacatgtaccacgtagagatttaaaaagttgcagttgtccaaacatgcctccatgcctttgtgtctgtggttttcatttgccagaaatgcctttttgccttttactacctgagcaagctctaactcaggggtcagcaaactatggccctctgctggtctgtaaataaacaagtgtttggaatgctaccatgcttgtttgtttatgtattgtctatggctactttctgtgctatcataacaaagttgagtagctccaacaagagactatataacctgaaaagccaagaatatttactatctgccccttcagagaaaaaaaatactgctgattcctgctctaactcaagttccatctcctcttagatgtttctgagttcctgtgacattttacctacttttgatatattgacaaaagttactgccctgaaagaataattatttatgggcttgaaattaaggggagagaccaagacttattacttatctgtatactcctgttgtctatcaagtctacgacacaatgctcaataaatgctggctaaacaaatcacagaaaacaaacctgcatgctggacattttgatttgcttgcagctgaggggctcctgaattcccaggggtggttgctgtggtcgaaggcacctgaccttgcataaagttcggattggcctgtcctgctgagaagccaggtgggaggcgtttaggcattccttaatagaaaacaatgagtaaggcagttacctagcaaatttatactcttgcttagatatggaatgaataaggaaggatgagctgcatgaagtctccactggcttagctctctctgtcacactggtaggatctttaataataaggttgggaaagatggttaaaaaaatcaacacaatctcttatatgaggcattgtcaaaatgaaaaataaatactaaaaaacttacacttagaacatgccaaggaaaagatggcaatctgctccctaaatgtgatctgaggccacgccacagcaaggtttgagggctcacttttctctgtaattaacaatggaccccaaaactttagttattttaacacaggcaccaaaggaatatgctaaattctctcatttcaaacaaattgatgtgaaatagtataaaacaaagagatgggtcctgatattaaggatagattgattatttttcctttgagggaaactgatggcaatctcctttgcagaaaatttccccccattattgcgcttgtctctttggaagagacaggagattagaaacagttcatgggagcttcaaagtgatgctgtattaaatcattatgctttcccctcataaggtttgctgtgattctgacaggtttggtaccaaaaaccatactctaatggaatctttctcaagtatcagttcctttttggaagggctaattttagaaaacttgtaataaggagaatctcagaacccacttatcatttacaacacaggccttgatgtggccagatcacctaggtgagcatatcatctgctctatgaaagcatcaagacctaaactcacttaaaaatttattacattcattcatttatttatttacttttatttttattttttgagatggagtctcgctctgttgcccaggctggagtgtggtggagcaatctcagcgcactgcaacctcctcctcccaggttcaagcaatcctccctgcctcagcctcccaagtagctgggattacaggtgtgcaccaccacacccagctaatttttgtatttttagtagagacggggtttcaccatgttggccaggctggtctcgaactcctgacctcaggttatctgcccgccttggcctcccaaagtgctgggattacaggcgtgagccactgcgcctggccatttatttttttaagggccaaattttcaatgtcctgaaaaactcttagtagacaaatatgcatttgtcctttctttaacagtgacaagtcccatttgcatgctcccactgtaattaaatcagtaatcacatttgcaggagggactacccagcttccactgatctggggtagatacccagaacagtgaaatttggagctgaaacatccttgcattttctaagaacttcttacaattcaaatattagagcctgcatgtcagcaaaattaattacaagagagtaaaaggctgatgagcaacttaacttcatcagaaaccatgggaacatgcctttgctatgttgcactaaagatgcaaggggttttttctgggtaggcaatgggtgtcttttggtggggagtatgtttatcagatgacagtattactgatactctataccttactgaaaagctccaagcacattcatgtgcactagatcaatgattaataagaataaataataaacatggagatggataagttttactgtaatcgttttacctctcacacattaagctccattgctttttcttcatacaagaggcaccttacaaaataaataaataaatctcctttaggtataactggtggaattccctctctaaggagcaggcattggcattataaaactataaaagtcaatgatttctgaacttattcccctttaatactttaaccaaacttaacaagtaccatgcttactattttattaactaggattatcaaaattgataactaaaagggccttttcttcaatgagaccctgttctttttattttgctctattgcataatcttaatttttcagcaactgagaagtttaaattgttaacaaaatgcatttttcttctggacattttaatttactagtacaagatcaagcaaaaataatttgaaaaacaaaatgaacatctctacattgaattttacctgaattttagtccagagagctagcttaaatttaaccagtaagatgctgcataacgtatcaagttaactttaagttatatcaagtgtcaccaccatatccacaaaaccaaataattatatccttactccactccctccattaactctaaaaactgaagttctactaagatctagctccagcaaatttaccaacacaaatagctacagtgttcctcacctcctaggcctggatgtaaactctgtggcccctggtttggtggttgctgctgcatcaccatgaagttaggtggcacatttccctgttgaaccataggattccgacccggagagctgacaggctgctgaaatccctggggaagtgggttattttgaggtggccttggtcccatctgctgctgagtttggttaaccgttggggaggatgcaggggatccctgctggaaggaggagggtgaggaggcaggagacttgttggtgaggtggggctgctgcaagggagttgggaccctagagggccctccctgcaaactcttcatctgaggagctgtgaactggcctgggttgctcatctgaggaaagtttgtgtgggcttgtgaggcttgctggctgccaaagggatatggagggggagggtgggaaggcgtctgtaccgtggctaaggatggtcttgcctggagttgctgttgcattgggccgggcaagggagccttcttccacccttggtttgcagtcattgtgcccagagaaccctgggctggaggaggttgaagggctccagaaggcagctggttccagcctggaggaacaggcacctgagttggggcagtaaactggggtcgaattccctgtggctgttgctgctgatgttgctgtgggggtcttgcctgcaactgttgttgctgctgttgctgttgttgctgctgctgctgctgctgctgctgttgttgttgttgctgctgctgctgcagctggggaaaattagctgggttcatttgtctgttcacagagacaggctgcattgggtgatgtgggggagctaaagatcctgagggatgactttgctgctgtatatggagcccagagaggagtggatccattgcatctgtttaaagatagtcaacaaagcaataattaacctactgcaatctagatcttagagaagtggcctttgtaattctggatatacagagcaaaatctgctggtactattcgataaaataaatgcttgtgaataccttctatgtatgaagcaacataccaagatgatgaattctgtcttaaaaagagcttggtcagtagtggacattaagagcgaagtgtaaaacatggagaccagtatttaccaaatcatattctggagaactatgttaattagcattataagaaaacaaaacaattaggtttgggaaacactgaacctaacaaacttagatgcgtttcttcactgtaggactttcagtgcctccaatatgttacttttgaatctccaggagggagggtaaagaatgatgcatttaccaaatttacttgactacagaattctatgtaatgagcatcttgcaggactacgcaggccaaggcacacttttagaaatgttggggtataattgataagaaaacaatgagaaattctgaaaagaaaataatgacatttagtttgaagaaatcaggtcagattttgtaaagaaggttgacattgtgagtttggaaattagaaattcagcatcagagataactgaattttataatgatctgtgcagaaagtttcagactcttcatcctcaaagattggaagtcattacctgactgagaagcagggcgaggagtcctgggctgcagctctggattggggcctggtgccatcatggaagatgacacatttccacccgggggtatcataacagtggcagggttgttcatccttattattcctagaaaaaagatccctaaaatagagtactggaattggcacaatttttgttttttaatgagttatttcaagaatatgaaaagatatggaaaatttgtttttttttttttgacagggtctcgctctgttgcccagtctgccaagtggcacaatcacagctcactgccatctcgacttcccgggcccaagtgatccttctgagtcagcctcccaaatagctgggaccatgggcacatgccactgggaccacaggcacacaccactgtgcccagctaatcgttctatattttatagagatggggtcgctatgttgcctaggctggtctcaaattcctgggctcaagcgatcctccagcccagccctcccaaagtgctgggactacaggcgtgagctactgcacccggcctggaagtttctacacccaccatctacctttttaaaatttaaaaaatttgctcttatgtccttcagatatatatgtagatacagcagaagccccctactccttccattccacttcctccctcttattgcaattgtggttaacagttctgttcttgtttattgaccttttctgtatctgtaggtaaactgcactttttctgtagataaacattttttgtatgcttttaatctttgtataaatggcaccttactatatgcattctttgtcagcttcctttttcacttaatgtattttttgagattcatctctcttgactgttataagggttccattgtatagaagcatatatccacccttctgctgatgaatactaaggttttatttttcctttattcttataattttgcaatgttgtgtatttgtcatgaattcttgtggatacatgagagtgtctttagactatatatttagaattgctaggttttaaagtctaagcatctttaattttactagatattggtaaactgctctcaaaagtggttataccaatttatactcaaactagcagtttgagaactcctctttctccatatctgaaaatttctgatactgctaaacttttcagaatttatcatctatgctcctaagtgagaataggtcaggcatggtagctcatgcctgtaatcccagagcttttggaggccaaggtgggaggactgcttgaggccaggagtttgagaccagcctgggcaacatagaaagaccccatctctacaaaaaataaaaaaatcagccagtgtggtggcaagcgcctggattcctagctatttaggaagctaaggcaggaggatcacttgagcccaagagtttgaggctgcagtgagctatgatcatgccactgctctccagcctaggcaacagggcaagagcctgtcttcaagaaaaaaaagtgacaacgcctatacttattctcttttcctttccttggctacagaattctctgtcatggagcatcttgcaggactaagttggccaaagcacacttttaggaatgttgaggtatgaataagagaacaatgaaaaattctaaaaagaaaatgatgacatttagcttgaagggcagattttgtgacattttgatttttggcatcgaggtgaaaataacctcaaaatgagttggaaagcatctttcttctttttctatgctctggaagaatgtgtgtatctgttctttaaatgtctgagaaaactttcctgtaaaaccatctgggcctataggtcatactaattgatttacagggaaacagatttttatttcaatttcttaaatggctatagacttttcaagttttcaatgtcttactgtcaatttttattaaattataattttgccaacactaaaatttattagcatagttaattgtggaatatattttttctattctttttaaaaaatgatatataattcatatactataatattcaccttttaaaatttgtacttttttcattctttacattgtttgtgccctctttttttccttggtggtcttagcacattcatcagttttagctgtcctttcaaagaaacatcttttgggccaggcacggtggctgacacctgtaatcccagcactttgggaggctgaggcaggtagatcacttgagatcaggggttcgagatcagcctggccaacatggtaaaacccctgtctctagtaaaaatacaaaaattagctgggcgtggtggtgggcgcctgtaatcccagctactcaggaggctgaggcaggagaatcttttggttttgctgttctgttgtttttttgattcatattttacttatctctattcttatctgtattatttccctcataacttacagctctgctcaattcttaagtcagacacttagcttgttaattttcagttggtgttctttcttaatataaatttctgaaggcttaacatttctttgaagtgttgtattggctacatctcacacatttcagtatatattattctcataattccattctaaatattgtctaatttccatcaggattgcttttttaaatcactaagtatttataatgcatttttacgtttccaaaaatatgagatattttggttatgcttttttttttttgccactgacttaacctaacagcactatggtcagagaacagaatctatgtgatattaatatttggtatttactgaaacgtgctcttggaataatccttggtcagtttgtataaattttccatttatgcttggaaatattaagaattcttgaattatgactgcatggttttgttttgttttttttctccgagatggagtctcactctgttgccgaggctggagtgcagtggcgcaatcttgactcaccacaacctctgcctcctgggttcaagtgattctcctgcctcagcctcccgagtagataggactacaggcacacgccaccatgcctggctaatttttgtatttttagtagagacggggtttcactatgttggccaggctggtcttgaactcctgaccttgtgatctgcctgtctcggcctcccaaagtgctgggattacaggcgtgagctatcgtgcccggctgactgcatggtttctatatatgtccattatataaaaagtattttgttattcaagctctcctttatccttactaattttttacaaacttggccatcaattactcacagaggtgtattaaatctcccctaaggtttgctgtttacatgcaattcttaaatgtcttgaggctaggttgttaaatacgtaagagtttagcaacttcctggtgaatttttccttttacattatatagtggccctatataccttcagtgatgctgtttattttaatgtctgctttatctggtaaaaatattattatgcttttcttggttaataatcaccttgttaatctttctatctttctaactttgaaccttctgagtccttatattttatgtgtttcctgtaacagcacataggtaaacctgagaatactattctgattaatcatttcctttttatcagtgttcataatccatttacctttattgtttactagtatattttgatttttttgtcattttatgatttctatttaccctttttttctattctgttttcctattttcctgaattttactggattaattttttttcatcatggtcatcctctttaatcctccactactagtttagaagttatatattccattcatattattttactggtatctttaaaatgtcagcagacatacctgacttaaagtttaaagacatatatgatcatcattattactaaataagtcaatgcttatttagatttaccccatgcttatcaattatttagctcaccattccttcttagatcttatttcttccatcttaggttcaattttcttcttcctgaagtacatccttgagcagttcaattagcaagggtctgttaatggtaaattctcttagtctctttgaaaagctctttatttcatactactcttgatagtatagctatgtttaaaattctaggctgtcaattatatcctcagcactttgaaaaaattattccaatgcttcctggcctccaatgctgctgttgagaaatcaagaaaagctgatagtctttcctttgtaaataatacgtcttttcttttgggttgcttttaacattctgtttttcaatgttctgtagctttacaatattgtgtctagatgtagttttatttttattttgtagtgctcaggaatactgggcttctgaatctgaggacttacgtctttcatccattctggaaaaaattttagccattctttctttgactgtcatccctcctcaatttctttatcttcttcaggaactcttttcaaacatatgttaaaccttctcattttattcttcttgtctcttgacctctttcatatttccatctctttttctctgcgcatcctgagtgatttattcaaattcaccttccaatccacctatttctaatttgctgaataagttatccactttgatgatttttaaatttctgtaagttctgttccccccatctctccttatgtttgatagtgtcttgttttcttatgattctcataattgttaatactctgacattcctattacctaaaattttagagggagggaatctaatcctaaattgtataaattcagaatataagctcatttatatcaggctttaactaggagaagtatgcaatgacttgggttgagaaaatacgcccctccacagcttcaacagttatcaccagtctagacctacctaatgttaatgacttagcctggctattaatgggtattcactaacatatcaaatgtccaaaatgcaagagggtagagaagacaattccacaacacccattctcccacctaacgtctagagccccagcgaacacagacaaatttcccattaatttccctatgccagagagtgacattttcctaatctatctttcactgaaaattctggcttcatgaagaattctgaattctaacttgcttcttcctgttgacccaaggctttatcttctatcccttcccggccattaaaacccaaatgctttggaccctgcagaatctcatttgtttactgccgtttaaatattcacctttgacatttttttttttttttttttgccctagggagttcctctactttctttccccatccctctgcttccaagcccagctacattttttttttttgttttttgagagggagtcttgctatgtcacccaggctggagtgcagtggcgcgatctcggctcactgcaagctccgcctcccaggttcatgccattctcctgcctcagcctcctgagcagctgggactacaggcgtccgccaccacacccggctaattttttgtatttttagtagagacagggtttcaccatgttagccaggatggtctccatctcctgaccttgtgatctgctcaccttggcctcccaaagtgctgggattacgggtgtcagccacagcgcccggctgcccagctacgtattaaatgttataggccggacgcggtggctcacgcctgtaattccagcactttgggaggctgagacgcgtggatcacttgaggtcaggagttcgagaccagcctggccaagatggtgaaactactaaaaatacaaaaattagccagacatggtggtgggcacctgtaatcccagctactagggagggtgaggcagagaactgcttgaacttgggaggcagagctcgcagtgagccaagatcgcgcaactgcactccagcttgggtgacagagcgagactctgtctcaaaaaaaaaaaaaagttatattttaagttttgtagttggagaggacagttaggctaatgtttatctgttgaaactggatctgtttctgaggaatcgcacctggttttttaaagatggtagttagacagttaagaaagctctcatgagggcttggtgcggtggctcacacctgtaatctcagcactttgtgaggcccaggtgggtggatcacctcagagcaggagttcaagaccagcctggccaacatggtgaaaccccatctctactaaaaatacaaaaattagccaattagctgggcatagtggcacctgcctgtaatcctagtcactcgtgaggctgaggtgagacatcgcttgaatccaggaggtacaggttgcagtgagctgagatcatgccacagtactccagcctgggtgatggagtgagactgcttcacaagaaaaaaaaaaaaagagaaagctctcatgagataagaaacaggtttttggctgggcgcgatggctcacacctgtaatcccagcactttgggaggccgagacaggtggatcacaaggtcaggagatcgagaccatcctggctaacacagtgaaccctcgtctctactaaaaatacaaaaaaaaaaattagccaggcatggtggcatgggaggctgaggcaggagaatggcgtgaacctgggaggcagagcttgcagtgagccgagccgagatcgtgccactgcattccagcctaggcgacagagcgagagtccgtctcaaaaaaaaaaaaaaaaaagaaacaggtcttcttggtccataatgagcttcctaatcccagaaaatttcaagtatatgctgactacatgttcaatagtgacactataacatgcattccagtactagatgggaatctgcacaagatccaaggttctcacctaggggaaattttgtcccctgggggacatttggtaatgtctggagacattttaagtggcacaaatgcagggaagtagtggtgctactggcatctggtgggtagaagccagggatgctactaaacatcccacaacacacaggacagcctcccacagcaaaaaattattggccccaaacatcaatagtgttgaagttgagaaacttgaattaaatgactactatagtatccccacaaatcttggaattctataaggctatgaaaaaaaacaggctatggatttagttttagttgcaaaagactcttgcttattagctaactttctgttgcccatgctaagagaagaaagcagtactaagaataattgaaaaaccaactgttgtagatacacagttctaaagttacttattattgttttagaggggatttaaggtctctttccctagaaaaatttagctgttcagtttaacctaatattaaactttgtttgcatccttcaagtctcaatagacaacagagaaaagcaatcctaaaatatgcttggcagtaaagagagatatcttgggggttaagatgttactgttactacaggtcattactaattgattattcctgaaactttatactatatacattatcacaatctgagtccttcattaaataccaatctaatctgatttcaacctaaagcttctcagtttcctaggttgataatcaactatagcactataattggctgggtacggtggctcagttcatgcctgtaatcccagcactttgggaggctgaggtgggcagatcacttgagcccaggagttcaaccagcctggtcaacatggcaaaaccctgtctctacaaaaaacaatacaaaacaaaacaaaaataagccgggtgtggtagtgcacgcctgtagtcccagctactgcagggctgagacaggaggaacacttgaccctgtctcaaaaaaaaagcactataatttacatgcacttcttagagatacttagtaaacatgcttgctatttgccagatactagcccaagagagcttttaattagggtactaataacagttaagtggcgtcttaacattttaagcctagaagggatctctagcattgtttccagaacataaagatgtttataggcaactagagtcagtacatattaagtcctttggccaggagttgagattagaacccagatttcctgatgctcatcccaggtttattcattctttcattaactatatctaacttggctaggcttttcccactctgcttctggcccatgtccttccagtagtggcaacagtgtcatctatcatttctcataaagctaccttaacaccaaatgctcagacttctgtggggaactacatctatgtacacaataccaggctggatattttacatctattttatggtattccacaacagcccaacagcacaggtcctgacatatatattttcctaagtcctaacaagaacttaggaaatgtttgctacactgctcagggctcttctaccttcaagcatgagctcaaaagatggtaggtattattatttcattttatatgtgaagaaagtattgcttggggaagtacagtaactagcttgaggtaacctgtaaatggtagtaccagaatgaaaacctagttccaattctatgatcagttcattagctacagttcagaatagcattttttttgttttgttttgagatagagtctcactctgttgcccaggctggagtgcagggtgcgatctcggctcactgcaacctccacctcccaggttcaactggttctcctgcctcagcttctcaagtagctgggattacaggcgcctgccaccacacctagctaatttttgtatttttagtagagatggggtttcaccatcttggccaggctggtctcgaacccctgacctcaggtgatccacctgcctcggcctcccaaagtgctgagactacaggcatgaccaatcgtgcccggccaagactagcatcttataaattgagctcctctatactgctgcatttctccaacagctactctggtagagtgggaggggaatgactgggtaagcaggttcttactctgcttcaaccacagcagctgtgcttttctgttttatttgaataaagggtcctgaagctgaaaaaattggaaagccactagtgcagtgaaaaaagcactgaactgggagttagaagatctgtgatactagtttatcgctccttgaccctgggcaaatcacttcctttatgtgagttccacagcttcctctgctttaaatgacagccaactcaattctaatattctgagattcaatctcagaatattgagttcaatctctgaagaagaaatttcaggattactagaaaaggaagcaatttataactctcaaattctaaatacataaaaacacatattctctcagatacatcttcagattccacataagcacacaagaactcaattcacagatattctctgcctcagagaaagtgggagttggaaagctacattctccattgtactattaaaataatgagggtagaaaatgtctcacttatttctatttccaacagcacaggtcatgtcacacaacaggaagtcaataaatgtttgctgcatggctcagtgttcatcaacctttaagcacgagaccaaaagattgcaaagatgcttcatgctgtgacctctagcctccgggaaggactcatgtctagctttcctgattcagcaaatagagatgttaagtatgccatgaacccccacctatcttgcagggctcaaatgatcaaataagccaaaaaaggaaactagtaaaatgtcatacaattgagtgggaggtcttacctggaccacttgccataggaaatcccgcctccatcctaactgaatttccagctcccatgggtccattcattctcacatcttggcttcggttctgagccaaagccaggttaatagcaccttcccctgaaaatgagtcaagtgataaaaaggaaatcattagaataaaatgcaaattttgtttatagacagctatataagtgctttagttttctgtgcttttgaagaattatggttagtttaccaccagaaaaatggtgggttcaatgtagatgggtctttcttcaacccatctaagcaggtttcatgaagcacaaggagatataaccaattcttacttgtaatagggaagcagggtgaccatgaatgatgcttagtatcaacagagatcctggaactctgaatatttattttcaaccatcttaccaattgtgtgtgtgtgtggggtgtgtgtgtgtgtaatggaagaaaatgttctcaaaaactctcaaaatcctagacttccttttggtaatttatgatcagaaggtagacactaaatataagtaggtttaaagaagaaagaacctatactggtgtggggacactaacacttgtgaacaaaataccaattccattcaataactgcaatataaacatatttccagcaggaaaaaaatcatgcaatgaagaggagataggttgctacaaatctactttctgagacacctaatgacaggaccaatacttttataggtttttgttttctgagatggggtctcactttgtcacccaggctgcagtgcagtggcacagtcatatagctcaccactaccttaaattcctgggcccaaggggtcctgctgcctcagcctcctgagttgctgggaccacaggcgcacatcactatgtccggctacgtataggattttttttttttttgagatggagtcttgctctgtcactcaggctagagtgcagtggtgtgatcttggctcactgcaaccttcatctcctgggttcaagggattctcctacctcagccttccgagtagctgggattacaggcgcccaccaccacgcccagctaatttttgcatttttagtagagacggggtttcaccacgttggccaggctggtctcgaactcctgacctcacgtgatccacccacctcggcctcccaaagtgctaggattacaggcgtgagccacggtgcccagcctgcataggatttttaattttaccttatttgagcttcacagtaccctcataggtaatgttactagaagtgttccaattaagtagactctaaacttagaggcaacttaaatcttacttggtccaatgataaaaacgtctctgaaacaagcaacagaatgtttcttgcacttaatccaaaattttgactattgttattgtaagagagcaccaccttgtggagagttaaaatatagctagtctgtggctgctgagctgaaaggctgcactcacccaagtccttctaaactgtagggttctgattcacagggtctgatggtaaaacagaaagttaatgaggtatggcagtttcctctgttctgtcactgatctaggtcagccttccttttttttttttttgagatggagtctcgctctgtcgccaggctgaagcgcagtggtgcaatctcggctcactgccatctccacctcccaggttcaagcgattctcctgcctcagcctcccgagtagctgggattacaggcacgtgccaatacaagcagctaatttttgtatttttagtagagacggggtttcaccatgtttaccaggatggtctcgatcttttgaccttgtgatccgcccaaagtgctgggattacaggcgtgagccaccatgcctggctaggtcagctttctatgtctattttaaccagggaggttcactggtcacagggaacaaacagcctaccaaaaaggaagcaatcactgggagctaccagatgctatagcttgcctctagaagtcaggcgtaaaaagagaaacagaatacaggtcatgagggtttccattaaaggaagggaactattaatatacaaaatttgttaagacattctaagtagaaagaatattgttctggaaaaggacatcagttcgtatcattccttaaaaacagttccattgcttcccactagtttagaaataaaggccaaacttctttttttttttttgaatcggagtgtctcactgttgcctgggctgcagtgcaatggcgcgatctcggatcactgtaacgtctgcctccgggttcaagcgattctcctacctcagcctcccgagtagctgggattacaggtgcttgccaccacgcccggctaatttttgtatttttagtagaaacggggtttcaccatgttggccagactggtctcgaattcctgacctcagacaatccgcctgtcttggcctcccaaagtgctgggattacaggcatgagccaccgtgccaggccaggccaaacttcttagcctatacaaggccttaaattatctacctagccaagtgttgttcaacagaaatataatatgagccacatatgcaatttaaaattttctagaagccacagtaagaaacagatgaaattatcatttattttacttaatacattcaatgtattatttcaacatgtaattaatgtaaaaattattattattttttgaaacagggtctcactctgttgctcaggctggagtgcagtggtgagatcacagttcactgcagcattgacctaactgggcttaagtgatccttcccacatcagcttcccaagtaggtgggactacaggagtatgccaacatgcctggctaatttttttattttaaattttaaattttttgtagagacagggtatcactatattgctcaggctggtctcaaactcctgtgctcaagcaatcctcctggcctcagccttccaaagtgctgggattacaggtgtgagccactcagcccagccaatgtaagaattattgagatattttacattcctttggggaataccaaatcttcaaaatgtaatatgtattttatacttacagcgcacgtcagttttaactagccacattttcagtgcctaaaagcaacatacagtctgtggctaccaatattggactgcccatatttagccctgtctacctctttaaactcatctcatgctatttttctccttcaatagcaaggattcagccccagtgtttccttttagtttcttaggcacacaaggctgcttctcaccccaaggcctttgctcatgcggtttcctctgcctagaacagttctctgcactcttcgcatagctagcttctcaattttcatgtaatcttaagtgtcacatgcccaaaaaggcctctaccaaccatcttatccaaggttaggtaacttttatcagaacatcttgttatttctgcagagcacattccatgtaatcattcactcactcgttttcttgcttgcctcccccatcactatacagggttaattacaagtctgtccttgttccttcacatctgttgttccagcataattaatagcattctctttcactttcagaaatgtcctaatttaggctaggcatggtgactcacatttgttaatcccagcactttgggaggccaaggtgggaggattgcttcagaccaggagttcaagactagcgacatggtgagaccccgtctctataaaaaattagtcaggtccgtggtggcacgcacctgtggtcctagctactcaggaggctgagatgggaggattgcttaagcccaggaggccggggctacagtgagttgtgtttgtaccactgccctccaacctaggcaacacagtgagactttgtctcaaaaaaaaaaaaaaagtgtcctaatttagatgataaattatatgactatctataatacatcatttatacataaaatagtgcctggtacgtggcagatgctcattagctatttattaaatataatggtcatcttataaccttataaagaattataagcatttttctatatgacaaattacttcctggaaaacctcacatttatcaaatctcatactgacaataacagggttagggcaaactgaaaacctgtgagactttgtaaccagagctctaataaaaacaataactggtggaggcaaaatgccagaaaaaaatgcagcagaaatgcctggttaaaggtgctgagataatgcacatgtagtggagttctgagccagcggggctgccattatggtgggcacaggaagaaatgcaacctgtcatgaactgagagccacacaaggctgggggatgcacgtcaggaaggcatacgaatatacactctcattcttaattttaatagagctgaaaagactcccacacatgcaacagctgagtgaaaagctttttcttgttgataattataattctatttctactattccagctcctcttacctaagaaaaaaaatcacatattaataaacagaatttccacactatactgctatcattcccctatttaccaactgcatatatgctaatttgtgtcaaagagaacactaccggctcccaaacttgccaattaggggtccacaaactacgtcctgtgggccaaatgcagcccactgcatgtttatttaaataaagtgttactgaaatcctgccatgtttacttgtttacatatcgcctatggctgtttttgccctacaagatggaactgagtacttgttgagttgagatcttatggcctgcaaagccaaaaatatttattcttggccctttacagaaaaagttagcagactactctttagatcaccatgaatttacagagggggcacaaaatgtcctcaaaaaagatgtttccccaattccctggccaaaacttaaaaaaggaagggtacaggaagtatttgtcaatggagaacggactgttgggagaacctgtccctcaagccttgcagcagacacgatagtggcaacattgcttcattccttcttttttgttgttgttgttttgagacaaaattttgctcttgtcgcccaggctggagtgcagtggcgtgatctcggctcaccgcaacctccacccaggaaaattttgctcgacacccaggctggagtgcagtggcatgatctcggctcaccgcaacctccacctcctgggttcaagcaattctcctgccttagcctcccgagtagctgggactataggcacgccccaccatgctcggctaatttttatatttttagtagagacggggtttcaccatgttggccaggctggtctcaaactcctcccctcaagtgatccacccaccttggcctcccaaagtgttgggattacaggtgtgacccaccgtggctggccaacattcttcttacaacttacaaaatcaacagcccagttccacaaaagcaatagctgctgccatcactttcactcctgctgaattcccaggagcatgggaacagagatcatctgggacacacatgtagcctaaaagttaaagaactctttctgtattgtgataatcattgtcatatgtgaatttcataatttcttaaaatatgttatctatttgcttccttgctagtactcatgtttaaatttatggctataatgttaagggagaaccagcattatattgttttaggaagtaggtctgcttaagaaataaaactggtacttctttctccagtgaaaaacactatcaattaaggttttgaagcctttaaataggtaacagagaccaaaaaacatgtggggttttaaagaaaccacttatgtattccttaaagtataaacagcccacatattgttattttatccaatagttgttcgacttccacttttcctaatagttcatcctacagattgctgtgaattaattgtacttttctggatccttttagatagttccacatttttcaaattaaagtggtattgcttaagccactattctctcatttatcaaatggtgaaaattatcccatttctcaatctacatataaccctttctaaataatttgtttgttggtattgcccctttgagggcacagcaacctacaatgctagactgcataaaatgtgtctcactcctataaacaaaatgacctcgactgctcaggtttcatggagcaattaggttctacgtaagcacagggccaggaggacctggactaaagtggaagggaaagctggaattgctggttgtcacctggctgtatcaacacaggaggggaagagagggttctagttcactgagcttccaaagagctcccccacacatggtaggtacttacatctctcacaggtttgtcttccttactaaagtcataagctcttccgagtttataacaataaggacaatatttatcattgtattccaaatgctaaagcttatagtctatggggataaaacaataatcaaataattgctctatgaaagtgtgagataaatgatctgagggagagaaacaaacttttgtgagagcacatagcaaaggactctgacttgccaaaggagttcagaaaatacatcctcaagatttaagctgatacttgaaggctgagcaggcatgaactaggggaagggggttggtagggaatagtatttcatttagagaagacatcaatgcaaaggacctgtggcaggaggaagagaaagctgagaagctggaacacagggggcaagggaggaaagttacacaagataaggctggatgaggaaggtagaggtgagaccatgcaaagcctgaggtcatggtaaggagtttggtcttcattctttgaataataccaagagatagcaggattttaatctaggggtgtagggttataggggtgtaggtgtgtgtgtgtgtgtgtgtgtgtctgtgcgtgcgtgcacgtgctcatcaaattctcattttgaaaaagatcattctggtaaaaatactgaaaatgaacactgcgggccggcgtgatggcctgtaatcccagcactttgggaggccgagagggtggatcacctgaggtcagaagtttgagaccagcctggccaagacggtgaaaccccatctctactaaaaatacaaaaattagctgggcatggtagtacatgcctgtaataccagctactcaggaggctgaggcaggagaatcacttgaacctgggaggtggaggttgcagtgagctgagatcatgccactacactccatcctgggactctgtctcaaaaaaaaaaaaaaaaaaaagaaaaaaaaaagaaaagaaaatgaatgctgctacaaaaggaaaggactgttgaaggcttcataatctgttagacgaataaagaaaatactaaagtttatttggtggaaggaaggaagcaaattaaattatatgttaagctgggtacagtggtataggtgtagtcccagctactcaggaggctgagatgggaggatcatctgaggccaagagtttgagtccagcctgggcaacacagaaagacactgtctctaaaaataacaacaataacaaagaaaaccacacaactaaataaataaataagacaaatcaattcctggtcaggatgccaataaaatcaaagtctgaaagactgatggtcaaaattagccaaaggaatggagtccaaggctacagatgctaaagaccatcaggacccagcaataacctcagtcagtccctcttcatcctaaggtgctgcaaagcaaagtacaagttacatgagttgcttggcattctgaaacacaagagcagaggaacagacaaagcagcacagaaaatcatgctatattctactgttgtaatgattctggtctagatgggcacatggcaaagtaaaagaccttcaatctgaacggagagaatccctaaatcccgaagctgctggttgttgctctgagcaaggatccgtagccgctccgctgcttcccgggggatgttgaatgtcacacgcacgctgttccagggctccaccttctgtacttttagcttgctggactcttgattgtgaaagaaaaagaattatattaataatcttttagccaccagaggagatggaattaaaaaacaaaccaaaagagcaaaagaataaggtggagcaccagcttggaatagctaacagagcatatgctttggagctacagactcaaatctaatcctagctttgccacttagcacctgggtgaccatgaacgagctatttaacctttctgaaacttatctttttcttttctaaaactatgaaaaaactacttcatatgatttttgggtacaaattagataatatatgcaaaaaatctagcatagtacctggcacaccacaggcaatgaacggaaagccgtaagatggagaaaggaccataagaaagaagagagaggttaagtttaaattaatagaataggctcatgcctataatcccagcacttcgggaggccgaggcaggtggatcacgaggtcaggagttcaagaatagcccagccaacataatgaaaccccgtctctactaaaaatataaaaatttgctgggcatggtggcatgcacctgtagtcccagctactcgggaggctgaggcaggagaattgcttgaacccgggaggcagaggttgtggtgagccaagactgcgccactgcactccagcctgggcaacaaagtgagactccgtctcaaaaaaaaaaaaaaaaaaaaaaggtaaaggacagttctccagaaaagatacacaaatggccaataagcacatgaaaaaatgcttgacataactaatcattagagaaatgcaaatcataatgataagataccacctcaccaccattaccatggctactatcaaaaccacagaaaataaacaatggtgaagatacggagaaatagaacctgcggggcacggtggctcacacctataatcccaataatcccagcactttgggaggctgaggctggtggatcacttgaggacaggagttcgagatcagcctggccaacatggcaaaaccccgtctctactaaaaatacaaaaattagccaggcatggtggtgcacacctgtagtcccagctactcaggaggctgaggccagagaatcgcttgaacccaggaggcggaggttgctgtgagcccagaatgcactactgcactccagcctgggtgacagaacaagactccgtctcaaaaaaaaaaaagaaactggaacccttgcgcactgtcagtgggaatgtaaaaggatacaagctgctgcggaaaacgacagtttctcaaaaaaaattaaaaatagaattaccacatgatgcagcaattctacctcggagtacacactcaaatgaactgaaagcagagtctcaaagagatatttgtacaccatattcatagcagcattacccacaatagctaagatatggaagcaacccaatgtctactgacagatgaatgaatcagtaaaatatggtatatacatacaatggaatattattatattattatttgagacggaatcttgctctgtcaccaggctggagtgcaatggcatgatcttggctcactgcaacctccgcctcccaggttcgagcaattctcctgcctcagcatcctgagctgggactacaggtgcatgccaccacgcccagctaatttttgtatttttagtagacacagggtttcaccatgttggccaggatggtcttgatctcctgacctcatgatcgcccgcctcggcctcccgaagtgctgggattacaggcgtgagccactgcgcccagccacaatggaatattattaagccttaaaaaggaaggatatcctgccacatgaatgggctttgagcatcttacgctaagcgaaataagccagtcacaaaaaggcaaaattccacttatatcaaggaagtagagtagtccaaaatcatagaaacagatagtagaatggtggtttccagggactagcagcaaggaggaaatggtgagttgttattcaatggttagagacgttcaatttttttttttttttgagacggagtctcaatctgtcgccaggctggagtgcagtggcgcaatcttggctcgctgcaacctctgcctcccggcttcaagcaattctcctgcctcagcctcccgagtagctgggactatagacacctgccaccatgcccggctaatttttgtatttttagtagagacggggtttcaccatgttggccaggatggtcttgatctcttgaccttgtgatccacctgcctcggcctcccaaagtgctgggattgcaggcatgagccaccacacccagccagagatgtttaattttacaagatgaaaagagttacatcctggctaacacggtgaaaccccatctctactaaaaaatacaaaaaattagcctggtgtggtggcgggcgcctgtagtcccagctacttgggaggctgaagcaggagaatggcgtgaacccgggagacggagcttgcagagagccgagatcgcaccactgcactccagcctgggtgacagagcaagactccgtttcaaaaaaaaaaaaaaaaaaaaaaaaaagacaagacaagacttagggcgacacatggtggtgattgttgcacaacattatgagtacatttaatttccactaaactgtatacttaataatggttaacatggtaaattttatgttacatgtattatacaataaaaaatactttttaaaaaagttaagtaattgaggaggtattattaattgtagttacattttacagattggaaagcaaatcccaggcacagttagctgataaaaaagttatttggctgcgtgcagtggcgcatgtccgtaatcccagcactttgggaggccgaggcgggcagatcacttgagctcaggagtttgagatcaccctgggcaacatagtgagacctcatctctacaaaaaataaacagaaaattagctgggtgcagtggcgtgcgcctgtagtcccagctacttgggaagctgaggtgggagaattgcttgagcctgggagatcaaggctgcagtgagctgagatcatgccactgcattccagcctgggtgatggggtgagacactgcctcaaaaaataaataaaaaataaaaaaagttattcaacaacctcaggcaaaacaattttctcttttgttattaactcagctaaacttaaacttctgtatccttcattcagttatacattctaatattaagataatggtcattcaacacctgtgaaaagaaggaaaaaagagataatggtcatagaggaatatgctttctcaaaatgagaaatatctaaggatagaggaaagtgcctacatgttgcctaaagccccttccagctcttaaaccattgtacattgaatgttaacttttccagacatggagttcacttgttctaatgtggaaaaaaaaacagggaaaacttgctaaaaggaatgagataacacaatcataggaatttagaaaagattagacaatatttagtccaagaccattttacaggagaggaaaccaaggcccagaaaggctaagtgatttgctcagaagcctgtggctaaccagtagcatcagagatgacattaaaacccagctctgattctcagggcaatttcctttccattacatgtaggcctccaaacagcaaaaggcaggaagtttggggatcctggttccaccaatcatagacactgcaggacttcttcccactctgaagtatgttggaatcttgtacatattctacacaaacatcaaatttgcttatggtattaacacttgtaatatgcttgcagaaaaatccatattcataacagttatatcttatcaaaatctttttaaacttccatatttgagagatttgacttaaaatattttttggaccaagaatataatctgatagcaccataaatctagagttggttattttttatttatttttatttttttgagacagagtctcgctctgtcactcaggctggagtgcagtggcatgatctcggctcactgcaacctctacctcccaggttcaagcaatgcctcagccacccgagtagctgggattacaggcacctgccagcacgcctgactaatttttgtatttttagtagacaaggtttcaccatgttggccgggcttgtctcaaactcctggcctcaagtgatccgcccacctcgacctcccaaagtgctgggattacaggcatgagccactgcgcccacctttatttattatttattttttttagacagggtctcactctgtcacacaggctggagtgcaggggcactattagagctcactgcagctttgacctccctgggctcaagtgatcctcccacctcagcctctcgagtagctgggactacaggtgcatgccaacatacccaactaatttttgtattttctgtagagatgaggtctctctatattgtccaggttggtcttgaactcctgggttcaagtgatccacccaactcaatctcccaaagtgctgggattacaggcatgaactactgtgcctggcctaggtttggtaatttatttgaaagccataaataaattgaattagcaatatgtaaacaacagaaaaatgtggtaattaatgaagagcaatgaacaatttcaggcccagcaagacctttataatatataactatgattatggttacaatgatgttgataactacatgaaaaattcttaattgtatgctaaataacgcataactatggagaaccttgtacaacacagtgaaaagcagttgaaaaaacaacagcttccgtccagataacaaatctcaaaagataaaacccccaagccttaaaagaaagctaattagctcttgatcaatttaggatttgtgataaaaggaataaatctaggcttttcactatgtccgaagggattagataattgtgctaactagaatagagaacatctaaatcaaggttcaaaaccacaaatgcccgtaagatatggacaggtaatctaaatgtgtgaagaagccagatgggaactgtggtgaagtggggctgctctcagaagcagctgctacttcgtaccatctgggagagagggagaactcaatgttatcagatcttcctatttttaaagacaaatgtaaaaatccggattttcatgcaatataactcaatttttaaagcactggcaatgaaactcaaacactgaaaacaaactaaatctcaaacactaacgtgggccaaataacaaatgcctgcagactggatccagcaagctgttagctagtgacttctgacataaaagttaaaggaataaatttaaagtatattataagcagattcatggaataataagttttctaagctttaagggtccttaaagattcagtttaaccttttcaatttacaggtaaggaaaatgaaaaccagagagttaaaaacaaataaatttgggtcttgagaattacttttatccactagagaagattattcaacaattaccataataagcaacactttatgttcagttcttctatgtacttaaaaagaaagaaaacatgtatatttttaaaatcctaaaattccacctctgtgcttaaattcagccttttgacccaatttaacaagcttgttttgtaaaactcaagataaccatggaagggcaaacatttcaaaaacagtaacaggaagaaaaaataattaaagcaaattacccatgtgtaacaaattgggcacgtttttcaatattgcatctaatttccatttgaagtctttatcatctatatttcctttgaaggccacaaaaattgtggaatcctccaaaatactatcactttttgtgtcatcatcttctagtccagagtcaaaatccatctctgagtcttccattgttgatgaacacaaggaagtatagatgtcttctaagtttggaaggtcatccaaaaccatggtgaatattattccagaagcatatgccaagaggacaataagaaaacttctgaaaagagaagatgcaaaagagcattacaatgcatagttatgcattcaacaatgtataattcatagttctatgaaaattataatttatttaataagaaaatactataaaaattaagaaattacagagaagataagctattttaattatgacattctaaaacaattagttcttacagttaccaaaaataaaaatacactagtcttaaatttaacattctttttattatgttatatgctacttttttataagctagaatgtcaggagaagggaagaaaggatcacaagaaaataaaacaagtacatactttttgagaattataggcctttggttgaccccacagagcaaggggctccccaagactccccctacttctgtcttgacaaaagcttaaaaggagccaaggtttctaaagccttcttctttctccaaactacaaagcacaaccagacctgactaatagcaactggatgattacctaaaattctgaagtctttcatgaaccattttaaacaactattaaagggttattaacagtggaatggctgaaaataatgattctgaaataaacacttaaaaattcttatatgaaagggctgggcgcagtggctcacacctgtaatcccagcactttgggaggtcaaggtgggcagatcacttgaggtcaggagtttgagaccagcctggccaacataatgaaaccctgccactactaaaacacaaaaataagctggacatggtggtgtatgcctgtaatcccagctactagggaggctgaggcaggagaattgcttgaatccaggagggtggaggttgaagggagccgaggttgcgtcactgcactccagcctgggcaacagagcaagactccgtctcaaaaaaaaaagggggttgatatggacaggtaatctttatggaggtaaagaactgtgttccggacagaattaaattgcttcctaaattttagatataaagaagttacattttctgctatcttcaggtatgctgcttaccaaagagtacatgtattaaagatcacacagtgtggccatttcctctgttagtttggggattgaagatcacatacttaacccaaaagtaaatgaatgaacattaattttcagcatttgcggtaagcaaaaatggcatggaaacctaagaacctcccacaaatgttctaataaaataattccttataattttaactataatacaacattgattgattgattgattgagacagagtctcacttttttgcccaggctgcactgcggtggcacaattcggctcactgcaacctccacctcccaggttcaagcaattctcctgcctcagcctcccgagtagctgggactacaggcaagcaccatcatgcctggctaatcttttgtagttttagtagagatggggttttgccatgttgcccaggctggtcttgaacttctgagctcaagcaagccattcaccttggcctcccaaagtgctagaattacaggcgtgagccaccttttatttatttatggcacttatttatttatggcacatgtccagcctttatttatggcacttatttatattattaaagtattacgaattattactttatacttataactataattacaagtttcttaaaaaaaagatggataagaaaattaatcccctaaaaagcaactatattaggttggtaggatcattgataaattttattttcctattttccaaatatgctgcaaatcattaggaaatacaaaactgctgtaatatggttatattccttgcataaatgaaaaaaagtaactcaaacaccgtttaacttttttttttttaatttatttttttgagacacggtctttctctgttgctggaatgtagtggcaaaaacatggctcactgcagcctcaacctcctgggctcaagtgatcctctcgcctcagcttcccaagcagctggggttacaggcgtgtaccaccgtgcccagctaatttttaaaattttttgcagagattggatcttgccatattgcccaggctggtctcaaactcttaggctcaggtgatcctcccaccttggcctcccaaagtgctgggattacaggcatgagctaccatgtccaaccaatttttcttttttaaatagtgaggctggtggatggcttgagggcagcgatttaagaccagcctgggcaacactgtgagaccttgtctctacaaaaaataaaaaaattaactgggtgtggtggtgcatgcctatagccccagctactcaggaggctgaggcgggaggatccctcaaacccaggagttcgaggcagcagtgagctacgatagtgccactgcattccagtatgggtgatagcaacatttttgtctctaaaaataaaaataaaataggctgggcgcggtggctcatgtctgtaatcccagcactttaggcggctgaggtgggcagatcacctgaggtcaggatttcgagaccagcctggtcaacatggtgaaaccccgtctttactgaaaatagaaaaattagctgggcatggtagcaggcgcctataatcccagctacttgggaggctgaggcaggagaatcacttgaaccctggaggcggaggctgcagtgagctgagatcgcaccactgcactccagcctaggggacaagagcaagacttcatctcaaaaataaataaataaaataaaataaaaaaattactactgactaaacttcaacagcaaaggctttccaaaaaccaacctaagcaatccttgggggaaaaattcttctgttataagtaaatatggcaaaaatacttccaaatttgagcagagcaccttgtgttctggcaattatatccttttctagtgctatgactgttacaatgaaactgatttgggtggttaagaaacaacagcagggtcagtggctcatacctgtattcctagcactttgggaggcagaggcaggagtgctgtttgagcccaggagttccagaccaggctaggtaacagcgagaccatgtctcaatttttttaaaaattaaaaaaaaaaaaaaaaagatacaacagcagtcagaaaatctcaaattaataccactgcccttatttgattgccatctgcattttacagatttttaataaactttagaggtaattaaacaaaactaatgaagatttttagggcttaaaagttgctgcttagcaggaaaaatgatgactgcctaaaaaactatgactatttagcagctattccaaagttggaacaactgcaagaaaacatcttaaaatctaagaaacattttccaaaagaatctttaaccagaaaggagactaactaaaaagcctggactttgatagtctccctaaacaggtcgttggtcatgacatgaggactatgtatctagatctggaaaatcttctactggcagatacaggaattgtcagtttaacaatactatgggcattacacagtacttaaaaaaaaaaaaaaaaacagagagaaattgaaagtcagtctatgaaaaattgctggctttccctccagaaaaaataatttttaaagaaacttctttggttggtaggctatttattactgcctcaatttcagaacttgttaattggtatactcagagatttaattttttcctggttcagtcttcctggttcagctgagagtgtatgtgtccaggaatttatccatttcttctagattttctagtttatgtacatagaggtgtttatagtattctctgatggttgtttgtatttctgtggggtcagtggtgatagcccccttatcatttctgattgtgcttatttaattcttttttcttctttattagacctgctagcgatctattatagctagtgatctatcaatttttttcaaaaaaccagcttctggattcactgattttttgaagggtttttcacatctctatctccttcagttcagctctattcttggttatttcttgatcttttgctagctttggggtttatttgctcttcattttccagttcttttagttgagatgttaggttgttaacttgagatctctctagctttttgatgtgggcatttagtgctataaatttcccacttaacactgtttaacactgtcccagagattctggtatgttgtctctgttctcattagtttcaaagaacttcttcatttctgccttaatttcattatttacccaaaagtcattcacgagcaggttgttcaatttccatatagttgtgtggttatgagtgaacttcttaatcttgagttctaatttgattgtgctatgatctgagagactgttatgactaaataggattccctatttaataaatggtgctgaaagaactggctagccatatgcagaaaattgaaactggaccccttccttacgccatccttacaaaaattaactcaaaatggattaaagacttaaatgtaaaacccaaaactaaaaaacttcagaagaaaatctaggcaataccattcaggacatgggcatgggcaaagatttcatgataaaaacgccaaaagcaactgcaacaaaaaaattgaaagtgggatctaattaaaataaagagcttctgcacagcaaaagaaactatcatcggagtgaacagacaacctacagaatgggacaaaatttttgcaatctacccatctgacaaaggtctaatatccagggcccacaagaaacttaaacaaatttatgaaaaaaaaaaaacaaccccattaaaaagtgcgctttcaggtctcccctgcctccaatcttattgtcctccaatctgtctccagacagcagccacagggatctttctaaaacacaaaataggccaggtgtggtggttcaggcctgtaatcccagcactttgggaggctgaggttggaggatcatttgagcccaggattttgagaccactcctgccaacacagtaagaccccgactctacaaaaaaaatttaaaaattaaccaggtgtggtgatgcacacctgtagtcccagctacatgggaggctagggtggcagaactgcttgagcctgggaagtcaaggctacagtgagctatgattgtgccactacactccagcctgggtaagagagcaagttcccgctcttaaaaaaaaaaaaaaaattaaaagagatcaattttggagatggcttaataggcctaggaaacaagttattgaggaaaaacctcaaaacaaactttgccatttacaaattaacctgtatttgatgcaggaccggcaagcctccaaagtggggcttagccttcaagcgttcttggcttcgcccaggagaacttaagggtgagccagggtagggtagaagaaaacagctctattgaagctgcagtgttacaactctgtgactgctcctgcagagcaggactaccccataggcagtgtgctgagactggcagctcagagcagttttgcaattatatttatacctaattttttttttttttttggagatgaagtcttgctctgtcacctaggctggagtgcagtggtgtgatctcagctcacagcaaccgccgccttccaggttcaagcaattttcctgcctcagcttcccagttagctgagactacaggcagatgccaccacgcttgactaattttttgtattttagtagagatggagtttcaccgtgttgcccaggctggtctcgaactcctgagctcaagcaatccgcccaccttggcctcctactgtacctggccagcagttatatttatatctacttttatgtatttcatttattttaatttttttgagatggagtctagctctgtctcgcccaggctggagtgcagtgacacattttagtagagatggggtttcaccgtgttgcccaggctggtcttgaactcctgacctcaggtgatccacccgcctcggcctcccaaagtgttgggattacaggcgtgagccatcgtgcctggcctatacctacttttaagcatgtagattaacaggtggtttatgcagaaattgctagcagaagtatggtaacttttgggtagtcaggtcattgccacggagaggggtggtaagtcttgggtgttgtcatggtaatggtaaactgacatggcacactggtggatgtgtcttatggaaagctgctcctgccccatccctgttttagcagtcctcaatttggtctggtgttcaagccctgcctctggagtcaatttccacctcctacctcatatttaggcttaactgaaggacatataggttttaaagttgaagattaagtaaacagcctgtaattccagcactttgagaggccgaagcaggcggatcacctgaggtcaggagttcaagaccagcctgaccaacatggagaaaccccgtctctactaaaaatacaaaattagccgggcatggtggcacatgcctgtaatcccagctactgggaggctaaggcaggagaatcacttgaacctgggaggccgaggttgcggtgaacatagcgccattgcattccagcctgggtaacaagagtgaaactccgtctcaaaaataaataaataaataaataaatctctttagcaggttgatgttttgccttggtgtgccaatgaattgctagattatgtgtcaagttcaaagcatctgaaaatttcaagttacaacttacaaaaaagtatatactataggttacgtggaagcctgatattaggaaatcaacaattcatctaagtgctgtatgaagcagcatctagaaagctttattcaacaaactttgagggaactatggtagtagtaatgagaaaagttaagtaaatagcagtgatcaaatgcaatttcttcaagtttcaatctatggaagtcaaccaatgacaacaatggtatctttcttactcatctaacaaataatttacctttagaaaaatataaggataaaaaggttattgtaaagccctacaaggaggaaatccaacagtttttctgattactgaggcatcaaatgcctgacattgtatttacaggtatcttgatattgtgtcacaggtttatcagcagttccccaagttcctactccaactttgcataaaggcttactatggctaggtgtgctggttcacacctgtaatcccagcactttgggaagccgaggtgggcagacggcttgagctcaggcttttgagaccagcctggggaacatggtgaaaccccatttctacagaaaatacaaatattagctgggcctggtggtgtgtgcctgtagtcccagcaactcatgaggctgaggtgaaacaatcccttgagcctgaggggagtgaggggaagggtggaggttgtggtgagctgaaattgtgctactgcactattgctgctctgagcaacagagtgagactctgtctcaaaaaaattaaaaatgactataaatactcggtaaatgtcaaagtgttatagtcacacacagcataacaataaaataatattcttcacggcaattattcctgccttaaatggaagaatattcactgaaaaacattaatgtaaaaacaaaatttaagaaaggccgggcgggcacagtggctcacacctgtaatcccagtactttcggaggccaaggcgggtggatcacttgaggtcaggagttcgagaccagcctggccaacgtggcaaatcccatttctactattaaaaaaaaaaaaaaaaattaagaataactctaaattacacatatattcacagcaacattattcacaatagccaaaaactcaaatgtccattaacaggtgaatggataaacaaactgtggtagatacatatagatagaatattatttagatataataaggaatgaagtgctgatacatgctacaacggagataaacctcaaaaactatatgctaagtaacagaagccagacataaaaggtcatatattgcataactccatttatttattttattatttatttatttatttaattattttgagatggagtctcgctgtgttgcccaggctggaatgcagtggtgtgacctcggctcactgtaagctccgcctcccaggttcatgccattctcctgcctcaacctcccgagcagctgagaccacaggcacccaccactacgcccagctaatttttttgcatttttagtaaagacagggtttcaccgtgttagccaggatggtctcgatctcctgacctcgtgatgtacccgcctcggcctcccaaagtgctgggaccacaggcgtgagccaccacgcctggcctattattatttttgagacggagtctggctctgtcacccaggcaggagtgcagtggcgtgatcttggctcactgcaacctctgcctcccaggttcaagtgattctcctgcctcagccttccaagtagctgggattacaggcacgcaccaccatgcctggctaattttgtttgtttttaggagagatgaggtttcaccatattggccaggctagtctcaaactcctgacctcaagtgatacacccgcctcagcctcccaaagtgttgggatatcagccgtgagccaccgcacccggtctaatttgtatgaaatatctagaataagtaaattcacagagacagacagacggattagtggttgtgagcgggaggtataggggatggggaatgggacatcttaatggttatgaagtttcattttggagtgacagacatgttttggaactagatagaagtggtggttgtagtacaatgtgaatctactaaatgccactgaactgttcactttaaaatggctaatttatgttacgtgcatttcaacctgatgcatttttaacaactcagaactcagcccactccatacagaaagtagcacatttaatttcttctcgaaacatgcttttagaaaagtattttccctaggtaatttttcttgtatctttttactgctttaaaatgtcaattgtgcacccatcatgagtattctctaagtagggagcagcagtctttgtcagtcagataaagatttacatagaagagtagctgcttgtggcaacagctctacagtgcttgcttccttctttgttcctaatagcactccttctttcctcctaggatctgggagtgaaggactggtcgtacctcaatgcactgctcaccctggcagaaatgacggccttctgctcctggcacaaagctcttaagtctcagaatgaaagaaaaaaaaactttctagatacaaaaactacttctcagtaacttgcaaatgtcagtgtctttaaggaaaaccagcaataaactcttaaattacatttaatgtaaacaatgactgcttgccagagtagtcacttcaacaaactgagataaaaatctaaggatgttagggcaccaaggcacatacccaaacccctgtcataatactgtacatgaaggaaattctcaaaagaagaaggagagagggcagggagatgatgcaaaaatgttctaatattagcaacttctcatgggcttatgaagcacttctgaagagtcccctgtgccaatttaaacccattatgacatacctcccagtgggggactgccaggatctgttattggagtgctatacaaaagctaggagggagggaaatagaaatttcaagataaaaacagtctaattttttctgggctttagctcacctcagatctaaatacagcatcaaactagagttatgttgagtttgcaactttcaacatatatttctatttttaatcaaaggtatttatttgaagtacaatatcctattatcattttaatcaacataaattctaaaaataagtattgtttactggtctttcattgtcttctacagtgaaacctaagattatcatttataaaaaagatgagaaactacatagtttgtagtaaaaaccccatttaaaaacagaagaatagcatctgtattttattaaatgtctccaagaataataaatgcattctacacagtttttccaaaagagagacagtatcagaaaaaaaaaaaaaagaataagcattaagttggctttattaactctctcgcataaggtttcactcaccaaaatctctttcttaatttttatcatttatccaggtcatcttctaagtccaaagaagctggcatttttagggcttggatttcaaggtagcagcccagcagccaaatcaaaattctaaaaacaaacaacaacaacaacaacaaaaagagagagagagataaaataaaaccacagtattatatagaaattaaagatttctttaatttcataacctatcttttcaacaaaagtcaatgtaaatatcacaagttatcaagtcagcattggcatctttagagaatgttaaaacagggttttcattaagtctacaaagattatcttttctgatttttttttttttttttttttgagacagggtctcactctgtcacccaggctggagtgcagtaacagatcatagctcactgcagctcaacctcctaggctcaagcaatcctcccacctcaggctcccaagtagctgggaccacaggcgcatgccaccacatctggataatttttttgtattttttttggtagagatggggtttcaccatgttgcccaggctagtcttgaacttctgggctcaagcgatccacccgcctgagcctcccaaagtgctgagattacaagcatgagccactgcccccagccttttttgagattttaggccactcatcagcaagcattcaaagattgtagaagcaaaactcacagacttatacaagcatcacttaagaatcataaaactgtcactttaagccttagagccctctctataccttcattcttaattctgtccagattaattaacatcaggtcacactatctgcatatgcttagagcccaaaacaaaatattttgtacacatacaaaatacaagacccgcttttctaacaggatttcaaatttagctttttaaacttgacaaagttttaggtgtaagtttttttcctattttatccataatatctatacattatatttttcattaaattttcagtttaagtcttgaaatatttactgtagatataaaacttatgcatggaacttgcatggtggtgcatgccggtggtcccagctattcaggtgactaaagcaggaggatcacttgaggtcaagagtttgaggttacagtgagctatgatcatgccactgcaatccagtctgggcaagaaagctagatcctgtctctaaaaaaaataataataaagccataagagaaaagattgataagttcaaatgcaaaaaaaaatcaattctgcaaagcaaaaaacattgtaagtcaaaaaaacaacaaactaagaaaaaaatacttgcaatcatatcagtgataaaagaacaaatctccctatatagaatgatatagaaaaaaatatgcataggtatgtgtatgtatatgtgcttatacaggcacataaaataaaaagatcaatttggacaaatgtataaaaatggacacagaatatgatcagaaaattcacagaaaaagaaatacaaacgaacattcaacatatgaaaagatgtttaccctcacacaaaagaagcaaaaaacaatttttcactcatcagattagcaaaactccaaaaatttgataatttactgttcccagcaaggttatggtgaaacaggcactcttattcattgctggcggtagtgcaaattggtacaccagcaattaagtaatgtctttcaaaatcacaattacaagctgggtgtgctggcacacacctgtaatcctgggtacttgagaggctaagacaggaggactacttgaggccaggagttcaaggctgtggtgagctataatagcatctgtaaatagccactgcactcaagtctgggcaacacagtgaaacttcatctcttaaaaaaaattacaattgcataaactattaacctagcaattccacttctggatagcaatcctacagatacacttatcatcatataagatgacgtatgtatagtgttatgcactacagcactgcttgtaatagaaaagttaggaaattacccagatgtccatcaatgggactgatttaaattatagaacatccttaaaaatgaaatgcaaaaaaaaagaaacacagcaagaaggaaaatgctgtctgtgtactgacacaaaaagatctccaagatatatttttgagagaaaaaaaacagagtaaaccattgagtaccttgtgctactttttttggggaaaggggagaaaaaatattttatacatgctagtgctaaaatactctagaaagaaatataagaccaataaaaatggttatcttacaaggtgaatttaaaaaatgatgttataccagagggaaggaagcactcacactaatgaggagtgtgttacaagaacacaggagccagttttaagggttttccactgggcaaatttgagacaatttgagtaccaaaagagaataattactaaaattgatatcatgaataagaatccatgaatctccagcaataactcagagagtgaaaaactttaaaaaaaaacacttcttcccatcattggaggtaactatgacattaatgacttattctgaagattgataattaaagagaaagaaataagcaatttacagcctttttagaagggttcatcctcggtagagcggcaaagctctcttacagaagactaccagttaataaatgtagaagcaaagaaagaatttcaaaatcaccattttgcaaccccaaatgaaataaatgattcaggcaaggacgatcacaggttgctaaaaatcatttttgcatgatcgaaaattgttggaaaacaggttaccacagtgccaaaggatcattccagagattacttccgaattgcaaaggggaaaaactgagtaccattataatgggaagatgtgacagtcaccagcttaacctagtgatcaaactcagcaacaatcagagtgagactcttcatttatgcctcttgatgtgatgtaactttaaatacacagactaagttatgatgtattattaccaaaagtgcctaacctaggtctaaacaagtcttcaacgtaatttctccttcacaggaattcaagagatagagcaacaagaaaaatcacaagaaaacgtaatctgacagaactagaatatggaacttgctacaataaaactggtctggtctcttcaaaaagccaaaatcttgggggaaaaaataggggaaggatagagttctagattaaaagagactgaaagtcacaacaaccaactgcaatgcagaaatgttactcagatctggtttgaagaaaacagtttgaaataattttttaggcagctgggggaaactgaatgtgaactgagtagaaggtattagggcattatttttaattttcttgggtgtggtaatgttatttgtaattaggtagagaatgttctttattcttagaagatgcatgctaaagcacagggttataaagtgtcattatgtctgcagcttgttttcaaattattcaacaaaggtagatattacaaatatggcaaaatgttaacacttgtttaaactacatggtcttcatggtattattgtttcaacttttctatatgtttgaatttttttttttttttttttttttttgagacagagtcttgctctgtcacctaggctagagtgcggtggcatgatcacagctcacagcagcttcaaactcctgggctcaagtaacctcccacctcagccccagagtagctgggactacaggtgcacaaccaccatgcccagctaattttttgattatttgtagagatagggtctccctatgttgcccaggcttatctcaaactcctaggctcaagcaatcctcctgcctcggcctcccaaagtgctgggattataggtgtgagccaccgcacccgacctgaaatatttcatattaaaaaagttagaaccaggtatagcggctcatgcttgtaatcccatcactctgggggtgctgaggagggcagattgcttgagcccaggagtttgagatcagcctgggcaacatggtgaaatcctgcctctacaaaaaaatacaaaaaattagctaggtgtggtagtgtgtgcctgtagtcccagctactcagaaggctgaggtgagagaatcacttgagcccgggaggcagagattacagcgagctgtgattgtgccactgagctccagcctgagcctataagttcgagaccagcccaggcaacacagtgagatattgtttcaactaaaaaaaataaataaaaaattgactgggttttgtagctactcaggagactgaattgggaggatcacttgagctgaggagactgaggctgcagtgtgccatgatcagcattccagcatgccggaattccactgctttccagcctgggcaaaaaagctagcatcccgtctcaaattaaaaaaaaaaaaggttggaagaaaaagaccataaaggtccatgggagctgagggtgagatcgagacttctcactatgtatctttttgaataatgtttttcttttgaaccatgtgaatatattacctattgaaaacaaaagttagctataaataaaacctcttaaacgcttagtatcaatatttctactcttaccccatctcagatatgcaacaacaaaaatgtctcctgctttttatctccttttttgaagggggctcctctggctacatttccccacgagtcatttgactcatgataagaacctggaccatcagccagcatggccaaggagtaattgtgccacctcttcccaaagcccaggcagcacagctcacagctccgggaaagactccttccctctgcttgaggagaggagagggaagagtaaaagaggattttgtcttgcaacttggataccagctcagccacagtaggagagggcagagtcctgaagtccccattctagaccctagctcctggatgacatttctagacataccctgggccagaagggaacccactgccttgaaaggaaggactcagccctggcagcattcatcacctgctgattaaagacccatgaggccccaaataatcagcactgatagccaggtggtatttgctgtggggccatgagtgagactgagacatgctgtcttcaagcatgacccagcacattcccagctgtggtggctacagggagagactccttctgcttgagaaaagaaagaggagtaaaggggccgggtatggtggttcatgcctataatcccagcactttgggaggccgaggtgggtagatcacctaaggtcaggagtcccagaccagcctggccaacatggtaaaaccccatctctactaaaaatgcaaaaattagctgggcgtggtggtgcatgcctgtagtcccagccactcgggaggctgagacagaagaactgcttgaacctgaacctgggaggcggcagctgcagtgagccaagatcacaccattgtactccagcctgggagacagagcttccagcttaggtaccagagacactaagctacaagacaaagttccctttactatttgggctatgtagagcactaagcaggctctcggggtccccaattccaggccttggttcttggatggcattttcattcttttttcttttgtttcctctgactgcatattttcaaagaggctctgggcctgccctgggccagacaagagcccactgtcctgaagggagagtcctaggcctggcagcattcatcacaacctaactcaagagccttcgggccttgagtgaacactggcagtagccaggtggtgcttgccacaggtctggggtggtggcggccgtagggaaagatgcctctgtttgcagaaagaggacgaaaaaacgggaaggactttgtcttgttacttgggtgccagctcagctgcagcagaacaaagcactagatagattcctaaggtttctgacttcaggccctggcttccgaacatctctggacccacccagggctggagagaacttgctgccctgaagggaaggacacagcatggctggctttgccacttgctgactgtaaagccctagggccttgagtgaagaacacaggtgatagccaggtggtagttactacaggccttgggcgagagacccagtgctgtgctggctttaggtctgacccagtgtagtttcagtggtggggtggccacaggggtgcttgtgtaacctctcccctagctccaggtagctcagcatagacggacaaattccagttgtttgggagagagtaagaggagagaacaagagtctctccctggtaatccagagaattattctggattttacctaaaaccaccaaggtggtacctctatgagtctgcaagagccacagttttactacacttggggtgccacctaatgtagatacaaatgcagtgacaagagacctggatcacaacactcaagtccctttgaatactcggaaagccttcgcaagaaagatgggtaaaaacaagcccagactgtaaagactataataaatacctaactctccaatgcctagacaccaacaaacatccacaaacatcaaggtaatccaagaaaacatgacctcaccaaatgaactaaatatggtaccagagactaattccagagagacagagatatgtgacctttcagacagagaattcaaaacagctgttttgaggaaactcaatgaaattcaagatagctcacagaaggaattcagaatcctatcagataaatttaacaaagggactgaaataattaaaaaaatcaagcagaaattctggattgaaaatgcaactgacatactaaagaatgcatcagtctcttaccagcagaattgatcaagaagaagaaaaaaatggtgagcttgaagacagcctctttgaaaatacaaagtcagaggagacaaaagaatgaagcacatctacaagatctattaacagaaaatagcctcaaaagggcaaatctaagagttactggccttaaagaggaggtagagtgaaagagaggggcagaaagtttattcaaatgaataataacagagaatttcccaaacctagagaaagatatcaatattcaagtataagaaagttatagaacacaagccagtttaacccaaagagtactacttcaagacatttaataaccaaactcccaaaggtcaacgataaagaaaggatcctaaaagcagcaagacaatagaaacaaataacaattttaaaaaatacaatggaactccaatacatctggcagcagacgttttagtggaaaccctataggccaggagagagtggtatgacatattccaagtgcgaaaggaaaaaaaatttaccctagaatagtatatccagtgaaaatatcctacaaacatgaaggagaaataaagactttcccaaacaaaagctgagggatttcatcaacatcagacctgtcctacaagaaacgctaaagggaattcttcaatctgaaagcaaaggacgttaatgagcaataaaaatcatctgaagatacaaaactcactggtaatagtaagtacacagacaaacacagaatattataacactgtaattgtagtgtataaactactcatatctcaagtagaaagactaagagaccaattaaaaataataactacatcaacttttccagacagtacaataagataaaaatacaaacaaaaagtttaaaagtggggggaacaaagttagtatgtagagtttttattagttttctctttgtttatgcaatcagtgttgttatcagtttaaaataatggttatgagatattatttgcaaccctcatgataaactcaaataaaaaaatacaacagataagaaataaaaagtaaattaaaacataccactagagaaaatcaccttcactaaaagaaagacaggaaggaagggaagaaggaaaagaagaccacaaaacaaccagaaaaccaataacaaaacggcaggaataagtccttacttattaatactaacattgaatgttaatggactaaattctccaatgaaaagacacagaaagtggctgaatgaacaacaacaacagaaaacaagacccaatgatctgttgactacaagaaacacacttcacctacaaagacgcatacagactgaaaacaaagggatggaaaccaaaaaagagcaggagtagctatacttagatcagacaaaatggatttcaagacaaaactataaaaaagagacaaagaaggttattatataatgataaaggggtcaattcagcaagaagatgtaacaattataaatataaatgaacacaatcctggagcacccagatatataaagtaaatattattagagccaaagagaaagacagaccccaatacagtaagagctggagattttaacatcccattttcagcactggacagatgatctagacagaaaatcaaccaagaaaaatcagatgtaatctgcactacagactacatgaacttaataagatatttacagaacatttaatccaatggctgcagaatccacattcttctcctcagcacatggatcattctcaaggacagaccatatgttaggctacaaaacaagtattaaaattttttttaattgaaataacatcaagtatcttctatgaccacaataaaactaaaaatcaataacaagtgaaattttggaaactatacaaacacatggaaattaaacactatgctcctcaatgaccagtgggtccatgaggaaattaaggaggaaattggaaaatttcttgaaataaattataatgaaaacacaacataccaaaacctgtgagatacagtgaaagcaggactaagagggaagtttatggctataggcatttacattaaaaaagtagaaaaatttcaaataaacaacctaacaatgtatcttaaagaattagaaaagcaagagcaaaccaaactcaaaattagtagaagaaaagaaataaagatgagagcagaaataaatgaaattgaaagaatacacaagatcagtgaaatgaaaagctgcctttttgaaaagataaacaaaattgacaacctttaaccagactaacaaaaaaagagagaagacccaaataaataaaatcagagatgaaaaaggagacattacaactgatacttcagaaattcaaaggatcgttagaggctactataagcaactatatgccaataaattggaaaacctagaagaaacaaattcttagacacatacaatctaccaagattaaccatgaaaaaatccaaaacctgaacagaccagtaacaagtaacaagatcaggtgaaaccctgtctctactaaaaatacaaaaattagccaggcatggtggcacgtgcctacagtcctatctactcgggaggctgaggcaggagaatcacttgaacccaggaggtggaggttgcaatgagccgagattgcatcaatgcactccagcctcggcgacagagactccatctcaaaaacaaaacaaaacaaaacaaaaaacaagatcaaagccataagtaaaagccacaataaaaaagaagcctgggatccaatggcttcactgctgaattctaccaaacatttaaggaagaactaattccaatcctactcgacctattccaaaaaatagtgaagagaatagttccaaactcattctacaaggccaatattaccctgataccaaaagcaaagaaacatcaaaaaaagatgatagacacagtgataaacactaatgcaaaaatcctcaacaaaatactgacaaatcaaattaaacaacacattaaaaaatcattcataggctgggtgcggtggctcacgcctataatcccagtactttgggaggccaaggcaggcagatcacctgagttcaggagttcaagaccagcctggccaacatggagaaacctcatctccactaaaaatacaaaattagcccaggcacagtagctcacacctgtaatcccagcactttgggaggccgaggcagtcggatcacgaggttaggagatcgagaccatcctggtcaacatgggtgaaagcccgtctctactaaaaatacaaaaattagctgggcgtggtggcgcatgcctgtaatcccagctacctggcaggctgaggcagaagaatcacttcaaccagggagtcggaagttgcagtgagccgagattgcaccactgcactccagcctggcaacagagcaagactccgtctcaaaaaaaagaaaaaaaaaattggtgaaaatataaaaacgaaataatactatgatcatatattggttacatattaaaatatatcagttcatgaactgttcgaaacaactaagcaaaatataggtttaattatataattacattattttaaaatttttgcaagtcaaaatgcacatgaactgaaaggcaaaatgcaagttgagagttacacatttttgtttgttttagttttttgagtcagggtctcaccctgctgcccaggctaaaggacagtggcacaattcccagctcaatgcagccaagtgatcctcccacttcagcctcccgagtagatggacccaagtgatcctcccacctcagcctccaccatgcccggctaattttcgtattttttgtagagacagggttttatcatgttgcccaggctggtttccaactcctgggctcaagtgatccacccacctcagcctccaaaagtgctgggattacaagcatgagccaccatgcccagcgatttataaaattagaaatgaaaataatcaatgatcaaaaagcttgctacacttcgtaagtaatcaaagaaaaacaggtcaggcatgatggctcacacctgtaatctcagaactttggaatgccaaggcgactgcatcacttgaggtcaggagttcaagaccagcctggacaacatggtaaaacctcgtctttactaaaaatacaaaaattagcagggtgtggtggcctgcacctgtaatcccagctgctcgggagactgaggcaggagaatcacatgaactcagaggcagaggttgcagtgagccaatacggcaccactgtactccagcctgggtgacagagcaagacttggtctaaaaaaaaaaagaaaaaaaaaacaaaaaaacaaagtgaaatgtgtcttttttcatcaaactggaagatttaaaaataaaataattgtggcaatgtacaatgaaatagattaacatttacattttgcttaaatataagcaaatagaattatccttaacatcttaaccataagcttaacaatctaggaatctaacctaatgaaataactgattttgtggtcaaagatttatattcaaagaagttcatcactgacgggtgcagaggctcacacttgtaaccccagcactttaggaggctgaggcaggcggatcacttgaggtcaggagttcgagagaccaacctggccaacatcatgaaaccccgtctctacccaaaatacaaaaaattagctgggtgtggtggcacacacctgtaatcccacctactaggaggctgaggcaggagaaatgcctgaacccgggaggtggaggttgcgccactgcactccagcctgggtgacagggagaaacaccgtttaaaaaaaaaaacaaaaaaccgtcatcacagcttagacaacacagtgagattccatctctacaaaaataaaatttaggccaagcgtggtggctcatgccttaatcccagcactttgggaggctgaggcaggcagatcacctgaggtcgggagttggagaccagtctgaccaatatggtgaaacgccatcactactaaaaatacaaaaattagccgggcgtggtgacaggtgcctgtagtcccagctattcaggaggctaaggcaggagaatcatttgaatccaggaggtggaggttgcagtaagccgagatcacgccactgcactccagcctgggtgacagagggagaccttgtcataaataaataaataaataaataagcaagctgggtgtggtggcacacctgtggtctcagctactcaataggctgaggtgggaggattgcttggacctgggaggttgaggctgcagtgagccatgactgcatcactgtactccagcatgggtaacagagtgagaccctgtctcaaaaaaaaaaaaaaaaagttcatcaaaatattctgttgatggttcaacaacagaagtggttaaacaatttaaatatactcaaatattgcttcccattgagactaatgtttttgagaatatttaacatcatgagcaatatttatattttaaatataaaatatataaaacatgttacttccgctttctttttcaaaaaaattattttaatcacacataactgtatatatacatggggtacagtataatattttgatacatgtatacaatgtgtaataatcaaatcagagtaattaattagcacatccatcacctcatttattatttgtgttgggaacattcaaaatcctctcttctagctatttgaaaatatacaataaattatttttatctatagtcatcctacagtgctagagaacactagaacgtattcgtcctatccagctataattttgtatccattaaccagtctctttttatccttcccctgctcttcccagactctagtaacctctgttctactctctatttcttataccctttttttttttttttaagacagtctcattctgtcacccaggctagaatgcagtggtacaatctcaccttactgcaacctctgcctcctggtttcaagcaattcttgtgcctcagtctccctagcagctggattttcaggcgcgcactaccacgcccagctaattttcttgtatatttttagtagagatgaggttttgccatattgcccaggctgatctcaaactcctgggctcaagcaatccacccacctgggcctctcaaagtgctaggattacaggtgtgatccaccacacctggcctattctacgatctacttctattgtgatcaacttttttaccttccacatataagaacatatggcatttatctttctgtgcctggcttatttcacttaacataatgtcctccaggctgatgcatgttgctacaaatgacaagatttcattcttttatggtatatataccacattttctttatctagtcatgtactgatggacacaagttgattatcttggctattgtgaatagtgctgcaataaacatgagaatgtagatgtctctttgacatactgatttcctttcctttgaatatatacctattagtgggattgctggatcatatggtagttctcttcttagcttttttttttttttgagacggagtcttactctggtgcccaggccccagactagtatgcagtggtatgatctcggctcactgcaacctccaactcccaggttcaagagattctcctgcctcagcctccctagtactgggattacaggcgcacaccattgtacccagctaatttttgtatttttagtagagacagggtttcaccatagtagcctggctagtctcgaactcctgaccttgtgatccacccgcctcagcctcccaaagtgctgggattacaggcgtgagccactgcgcccagccctctttttggcttttcaaggaacctccataactattttccataatggctgtactaatttacattccaatcaacagtatataatagttgccttttctccatctttttggtaatagccactattttaactggggtgaaataatatctcattgtggttttgatttgcatttcttgatgactagtaatgttaagcagattttcatatacttgctgacaattttacattttctttggagaaatgtctattcagatcaagtacccaatttttaaagtcagactgtttttctactgttgaaacatttcagttccttctttattccagatattaatcccttgtcacatgaatagtctgcaaatattttctcccattctgcaggttatctcctcactgtttcctttgctgtgcagaagctttcttaactggatataatcctatttgccagcttttgtttttgttgcctgtgcttttaaggtcttatctataaaacctttgcacagaccaatgtcctgaagtgtttcctctatgttttcttttagtggtttcatagtttcaggtcttacatttaagtctttagctcattttgagttgatttttgtatatggtgagagataggggtctagtttcattcttctccatgtggatatccagttttctcagcatatgcattgaagagactgtctttttatcaatgtatgttttgggcgtctctgttgaaaatcagttggctgtaaacgtgtggatttatttctgggttctctatggtgtttcattggtctatgtgtctgtttttatgccagtgccatgctgttttggttacaatagttttgtatactttcaagtcaagaagtgtactgcctccagctttgctctttttgctcaggattgctttggctactcaaggtcttttgtggtgcctgccatacaaattttaggattgttttttctaaagaagtctgtggtagacagacttgtaaaatggccaccaattactccagcctcctggtgttcatgcctttgtgtaatctcttcctcctgagtatggactggcctggtgatttgcttctaactaacggactatggaaaatgtgataggatgccactccatgattataaaaaattgtgatttccatcttcctaggagacttgctattcctttctcagctttgtgatgttgaagaagctacatggaaaggaattcagagcaacctccagccatcagccagtgagaaaccaagcccttcaattcaacatcccttcaagaagagaattctgtcaccaaccaagttagtttggaaacagattattccccagccaagcgctaagatgagacaccagccctggctgacaccttgactacctcctgtgagagaccctgaaacagaagacccatctaggctatgccgattcctgacccatggaaacccatgccataataaaaatgtatgttgttttaaactactaaatttgtggtaatctgttatgcaacaataaataactattgtaccctacatggaaatcctgctgaataaactgcctggcaatttccttttttattttttgagatggagtctcgctctgtcgctcaggctggagcacagtggtgcaatctcagctcactgcaagctccgcctcctgggttcacaccattctcctgcctcagcctcccaagtggctgggactacaggtgcctgccactagtcctggctaattttttgtatttttaatagagacggggtttcaccgtgttagccaggatggtctcgatctcctgacctcatgatccgccctcctcggcctcccaaagtgctgggattacaggcatgagccaccgtgcccggcctttttttttagtttttgtttttttgtagaaacagtatcttgctggcggggcctggtggctcatgcctgtaatcccagcactttgggaggccgaggagggtggatcacatgaagtcgggagtttgagatcaccttggccaacatggtgaaaccctgtctctactaaaaacacaaaaattagctgggtgtggtggcaggcgcctgtagttccagctactcaggaggctgaggcacgagaatcgcttgaacccaggaggcggaggttgcagtgagccaagatggtgccactgcactgcagcctggtaacagagcgagattccgtctcaaaaagaaaaaaaaaaaagaaacagtgtcttgctatgttgcccaggctgatctccaactcctggcctcaaacggtcctcctgccctaccttccctggaactctgcccagccaggattcttaaatcaaatcacagtgctggaactgtgcccagccaggattcttaaatcaaaatatttttccctctatttataaatatttatccaaatatttatggggggaaaaaagtcacaggtcacacagtggccagttctgctttagctagcagtggttcccaaacttgtctgtgctttttttttttttttttttgagtcggagtttcgctcttgttgctcaggctggagtgcaatggtgcgatcttggctcactgcaacctctgcctcccggattcaagcgattctcctgcctcagcctcccgagtatctgggagtaaaggcatgaaccaccacgcctggctaattttgtatttttagtagagacagggcttctctatgttggtcagcctggtcttgaacccctgacctcaggtgatccgcctgcctcgacctcccgaagtgctgggattacaggcgtgagccacagtgcccagccttgtctgcactttagatcttcttgagatcttttaaaaattccaaagtccaggccatactcccagggcaatcaaatcacaatctgctggggaagggaaagggacaatggcatcagttgtccaagctccacaggtgatttcaatgtgaagacaggtttgggaaatcactgagctaaagttttatctgtgtgatcaagaaaaagctaattcaagatgacagagagagaggcagctgaatgaaactaactatatacacctgcccttctctgagatcgtaaggtagccttgatttccccctgcaaagttatgaattctgaaaatatcagagagaaggccaaataaatgcttattttgctttttggatttatccatgcctccattcgcctccagaattatgaacaagtgagaaattcacctttttgtcttttcttggtacttttcatggaaccaataaagaattctgccatattacatgtattcaacataactaataagacatgacttgaatgcttttttattaagcagatcttatttaatttagtcagttttgatccaacccacatgccaaatgcagcttgccaaagtaaaataccctatggacattaggatcaaaatgcctcctttttaaaaagtaaagtctatttataatccaatcctttaagttgaaattaggccttttataaattgaatttcatgtattctacagaatcaacagacctgcttaagaactctctgaccactctcagaaaagttagtcagtgggacccctctccattcctcccaggacctaaacaaaaaagaaaaagggcaagaggaagaagagaaacatcagaagaaaagactacatataaacccttataaacctattcaaaataaatttttgtgattggccaaattccttctctctaccactgtttctgctaattttactctagaaagagttgtaaaaggccaggtgctgtggctcacgcctgtaatcccagcactttgagaagccaaggtgggtggatcacctgaggtaaggagttcgaaaccaacctgaccaacatggcaaaaccccatctctactaaaaataaaaaaaattagccaggcatggtggcgcactcctgtagtcacagccactcgggaggctgaggcaggagaatcacttgaacctgggaggcagaggttgcagtgagtggagattgcaccactgcactccagcctgggtgacagagctagactgtctcaaaaaaaaagagttgtaaaagacagatgacctatctacaatttctagtccagtggcttttattaaggaaagcttataatcatcaaagaggctcaatatacttttgaaataccacagtagtggttacacaagtgtgttaattttataattcattaaccttataatttgtgtgcttttctttgtatgttacacatcaattaacacatttttacaatagatacatttgtcctgggcagaatctctgaaagattctaagtaagcaggtatcagaaatagtcaaggttacatgatttgtcctaggtcacagatatagttagctacaaatgaagtccttcatatcactttcctactctttctgttataaattgtaaatatgttgatattattatactttttaatttaacattactttcctacttaagactatgaaaaaaataagtattacaagtgagaactgcaaaaaacaagcaaacaagtaaatagaaaacacatgtcctgggttcataactgtgcactattgaagctattgtaccatccatatgaggaaattaaataaagcctaacgcccatgcaaccattttttttctttttttttttttgtttgtttttgagacggagtctcgctctgtcacccaggctggagtgcagtggtgcaatctcggctcactgcaagctccgcctcccgggttcacgccattctcctgcctcagcctcccgagtagctgggactacaggcgcccgccaccatgcccagctaatttttttgtatttttagaagagtcgcggtttcaccgtggtctcgatctcctgaccttgtgatctgcccaccttggcctcccaaagtgctgggattacaggtgtgagccaccgtgcccggactctgtgcaaccatttcttaacctcaatatcctttttcaaatgctttcaatgtagacatatgtcaaactattagtagtaaaatcaactgtgtacctattcagatagactagcattatttttgatatgaaaatatagggtgatagaacggaaaaagggctaggctgagcattgcagagtgggttttagtcatggctgtcccataaagttgttttatgatttagggcaagacataaatctctctggtctaagagtattaaaatgagaggatgaacaccagagctaggactaaacagaatctcaggttccttccaggtttaagaaaactcaaggactatttaacaacaacaacaacaacgtgtatatatatatatatatatatatatatatatatatgctttcaaaatgcattttacaaatgattatctctattcaaatatgtttaaagtagctttgtaaaataaaaatactagaattcctctggcacctgcttcataaatacaagcatattcttcagcttgtatcaaatgcaaacctctgatctgttgtctaggtgcaacaacctctccctctcagttggctaataataacattgttgattctttatcatcatgagactcttttgcctgcatttaaaaaacttcattttatgaatcaatttcagatttacagaacatgagttatttttatgagaaatatgtatctctcaatatgtaacagaagtctttcttaatttctaataatctactgtaatttgaaaactttccatggatgcatttatttgactaccctttaccaactgcctactagcactctgctaggcactttcctgctcctgaagttactatacaagaacaaaaagactgtggaatggttaattgaaacaacattatttcatgaatgcctccatctgaatattacacttatagtatttaaaaaattaagttggccttgtaaccacacaaccttaaatgtttcaggataacttataagacattgttaaagtgtctaaataaacagttaaatgctcactgttaaagacaatttgcctaggcataactattataagatccaatttcatcctccctataccctttcatgaggtccttataaaactatttcatggtggccgggcacggtggctcatgcctgtaatcccagcactttgggaggccgaggtgggaggatcacaaggtcaagagatcaagaccagcctggccaacatggtgaaaccctgtacctactaaaaatacaaaaaaaaaattagctgggcgtggtggcatgtgcctgtagtcccagctacttgggaggctgaggcatgagaatctcttgaaccagggaggaagaggttgcagtgagctgagattgcgccactgcactccagtgtggcgacagatggagactctgtcttaaaaaaaaaaaaaacaacaacaaaaaaactatttcatgcttattctcagatctggggctcccaagggaaaatttgtgcagctctccagccaaatcagagaaacttaatgctctgaaaggatcaacaaaatgcctgtcaaggtgattggcatttcaatacaacaaccctggtttgctcttggtagggataatagacaatttaagggattaggaaatattaacattaatttttaaacttcaatcctaacttcttagtataagaaacaaaagataaattagtaaaacatgaaacttgagatttccaaaaccactcatcccaacacatattataaacatattataaaccgtaagtcagaggctcagtgagatttttcccacgttgttacataaaaaaaacaaagaaataaatctgtgcccaaattgcaacaaagagaaaaaaaattacaaatgaataatacaaaaacagaaataaaatctagaagaggtcaggcgtggtagctcacgcctgtaatcccagcaccttgggaggccaaggcaggaggactgcttgagcctacgagtttgagaccaccctgggcaacatagggagaccccacttctacaaaaaaaatttaaaaattacggccggtcacagtgactcatgcctataatcccagcacactgggaggctgaggtgggtagaccacctataatgaggtcaggagttggaggccagcctggccaacatggtgaaaccctgtctctattaaaaatataaaattagctgggaatggtggaacacccctataatcccagctactagggaggctgaggcaggagaattgcttgaacccgggaggaggaggttgcagtgagtcgagatcacgccattgcactccagcctgggagacaagagtgaaacactgtctcagaaaaaaaaaaaacaaaaaaataggctgggtgcagtggttcacgcctgtattcccagcactttgggaggccgaggagggtggatcactttaggtcaggagttcgagaccatcttggccaacatggtgaaaccctgtctctactgaaaatataaaaattagccaggcatggtggcgggcacctgtaatcccagctacctgggaggctgaggcaggagaaacgcttgaacccacggggcagaggctgcagtaagctgagactgcaccactgtattccagtctgggcaacagagtgaaactctgtcttaaaaaaaaaaaaaaaaggtcattttggagacaactggagaaacttacagacttaatgttagataatattaagaaattactgttttgttaggtgttaataatggtattgtgtttatgtagaagaatatccttacttgcaggtgatgtgtgctaaaatattaaaggcatagtatcatgatatctttatttttaaaaagtttaacataataaacatattattaaacatatgacaacatgttgaatatagatggtgagtataagggtggttcactgtactattattcctggggctttttctatgttttaaagttttaataaaacatttaaaatatcaaaaaaagcccacaaaactgaagaactgctattatactagaagaaaaaatttatgaaattcaattttaactagtagctagtggcactataaactggtagttgttctgaagaataatctgacaatgtggctaaaaagtgatagcctcagacctaatgaaatcattttagggaatatattctaagaaaaaaactggaagaaaaaagatttataaaaagatgtaacagcgctacaatttagaattgtaaaatagggctgggcatggtggctcactcctgtaatcccagcactttgggaggctgaggcgggcagatcacgaggtcaggagttcgagaccagcctggtcaacacggtgaaatcccatgaaatacaaaatcccgtgaaaatacaaaaattagccaggcatggtggcgcatgcctgtaatcctagctactcaggaggctgaggtaggagaactgcttgaacctgggaggtggaggttgcagtgagctgagatcacgccactacactccagcctgggtgacagagtaagactccatcttggggaaaaaaaaaattgtaaaatataaataaaaacgaactgaaaatcacccaaatgccaaataaccagagtattttagactttggttgtcatatatccattaaaaatgataaatatacagatgtgtagaaaagtacgtcaatatattgccaaatgaaaaaagactaaaaaaacctttatatgaattaaatttgtaaagactgtatgaatatgaaaatgactcagaagttatgtacttgcggtatttaaacataatttttttttgttttttgagacggagtctcactcttgtcacccaggctggagtgctacggcatgatcttggctcaccgcaacctctgcctcccaggttcaagcaattttcctgcctgagcctcccaagtagctgggattacaggcgcacgccaccacgccaggctaatttttgtatttttaggagagacggggtttcaccatgttggccaggctggtcacgaactcctaacctcaggtgatccacccgccttggccttgcaaagtgctggaattacaggtgtgagccacagtgtacagccttaaacataatttttaaaatttcatggggacacgtgctattagaaaaagtataaacaatgcaaatataaaatcaggaagaactgcctgggcacaaataaagaaagcacctgagggctattactgaccacaattcaaatgagtattcacaatttaaatacagtactatcctgggcaaggccaacattgctaccattaaaaagacacaggctgagcacagtggcacacgcctgtaatcccagcattttgggaggcaagagtatcgcttaaacccaggaggttgagactggcctgggcaacataggaagacccattctctaccccaaaaaaaaaaaaagccaggtgaggtggtgaacacctgtagtcccacgtgttcactcaggagactgaggtaagaggatcgcttgagcctgggaggttgaggcagcagtgagccatgatcacaccactgcactccagcctgggtgacaaagcgagactctattttttttttaaataataatttaaaaataaaaagacacagaaaaagagcatatcattagcctggacagtacccagtcttcctcaattctatttgttattttaaaacaatactcagttttcctcaattctttccaatatttttttaaattatggaaaaactgaagaagtttcaaagaaaaaccaagaggtaaagaataggatggaaaagaggtaattttgaagaatggtttgaaatcaaatgaagtgtgacatgactattaacactgaaatatccatggggaggcttttgaatggagaccctgaaaagctgatgtatctctcaatgcccacagatgactcaccaagaagagagggctaacaaaaccctcaaagtttgttgttttacagaagagagatttctttattgtgctggcaaaagttactggcataggaaaatgagggaggctgggtgtgttgtcattgaccatctgtttttctacagggtgtttacttatccatgatcacctgatcatattagaatgtctctaaaacttgactcagttactcaaagcttgaatcaattatctaccatttcaaaattccgcagtgccatcctgctcccacacactggtcactcagcaacattcaaatgtcttagacctggcatccagggccccaagaaagtacgtcggcttcacttctccacaactcctcaacaaaccagcaaatcagacttctcactatttcattacctaaatattccttacattttcctatgtccatcattcctttggttactctctccttaatcccatttgttgcaatcttacccttccattttaataaattttaatttaatgcctctatgttatctcaaacactacctgttatgtgttgacttgtgccccccaatcccatccctgccaaatatgttagtcttaactctcagtacctcagaatgtgacctgatttggaaacagagtcgctgcagaggtaatcaattaagatgaagttactcctactggagtagggtgggacctactagtgaccttataagggaaatttggacacagagacatacagggaaaacgccatgtgacaacagaggcaaagatggagtgatgcagctacaagccaaggagcaccaagaattgatggaaggctcagcctctcaagtaggtgcgattagatgcacatgccagcacgcctggctaatttttgtacttttagtagagatggggttttaccatgttggccaggctggtctcaaactcctgaactcaagtgatccacccaccttggcctcctaaagtgttgggattacaggtatgagccagctatttgggaggctgaggcaggagaatcacttgaacctgggaggcagaggttgcagtgagccaagtttgcaccactgcactccagcctgggcaagggagtgagatgctgtctccaaaaacaaacaaacaaacaaacaaacaaaaaagagcagctgggtgcagtggctcacacctgtaatcccagcactttgggaggccgaggcaggtggatcacctaaggtcaggagttcgagaccagcctgaccaatatggtcaaaccccatctctactaaaactacaaaaaaattagctgggcgtggtggcagttgcctgtagtcccagctactcaggaggttgagacaggagaatcacttgaacccaggaggcggaggttgcaatgagccaagatctcaccactgcactccagcctgggcaacagagtgagactccatcacacacacacacaaaaaagcaaaagcaaaagcaaaagaaaatgtatataaatgggtactacggaactgatattcaacagattcaatatcagtaaaggagctgattaatgggaacttttgttgcctttgtgtgtgtgacggagggggaggggttgcagctggttaatgctaaatacaaactgaaatatctgtttaaagtatgaatgccctctgaatttggtgctcattaatattaactgatatagttaatttattaactgataatgaatattataactgacatagaatacacaattcatcacaaagtaaaggtatggtcctggccttctgctttatagagattgtatatcaaataaagcatatgaccaactctagggctgcattcctccttccatcaaagccatagtatttcatttgtgtatacatctaaatgtaactctagttatttactaattaactcagaatgtttattgagctcctaggcagctactttatgtcctttttagaataaggtgaggtagaaaaagatcacatttaaaaaaataaatgaatataccagacatcaaaataggcagacactggagctgaagggagggaagggggaaggcagagacagacaccagcccagtcctaaaggagcactcacccaatctagtgagaagtaagagagtaaactagctccatatctctcctttctccccatgctgatcctacacttcacaatcaggcttcctttcctaacgtacagctttcatcacatcactggcgaaaaacatttgatgacttcccactacctagtcaatcaagttcaaacttcccagcttggaatagaaatgggtattcaaagccttccatgatttgattatatggtatgcagagattaggaaggcaggctttgaaattagactacctggactcaaatactttctgtatcaattgttagctctcttcttcattttatatgtaaaaagggattaaaaaccagtgcctacctcatcaggttgttgtaaggattaaataaaatgctacttatgaaatacttagcacattatcttgcaaatagtaagcatgcaaaaaatgtgagccattggccaggcatatggcttgtgcctataatcctagcaatttgggagaccaaggcaggagatcacttgagcccaggaattaaagactgcaatgagttataatcacgccactgcactccagcctgggcaacagagtaagaccctggttctatttaaaaacaaaacaaaacaaaacaaaaaaaccctacccaaagaacactggggggaaagaaaagccactactactattaatttttttaagttttatttattttaggttttatctattattgttactattgttcatctccatttccacccttaattccaacaacacccttataacaatcctcttctccaagcaaagtggactctttaccatctcctaaatacccacctctgtgtttatgctttcactcagcctggaaaatacagcactgtctcatctccaagtattaagatactaactattcttggcagcttcgttcacagaccacctctttcaggtaccattctctagtatcccagctccataacacattacagacattcctcagcatagaaaccttggctagattcatcttggtatcttgcagagttctagccagtttccagaatacatggtagggctcaacaaatgtttgagaaaataatacctatatttcctttctcgtccaaccactctcttagacaacagctccacaatacaagtaaaaagagttcttctacagtatttcataaagctggccagctaattttctatcaccaatgtggtaatttctaatacagtacttaatacatagtagatgcctaaatattcaaggagctaagctgaatttcacctcatcttttaatttcatttatcattctattcattatgatcaagtatggctcatccttagaaataggttttagtatttacttgcccacaaactcatctgtcaatttctggccatcccccccaccatcccaatatgtcatttactggtttgggggagacaatattcaatacctcaataaagtaagaatcagaaaattaaatgtctgcagggccataaaaataaagagcaaagcaagacagcaaggcagactatggagaactaggaaacacatctcacctaaaagtttcagctggttaccgctataaatgaatatgggcttgctgttgacagatcttccaatttttcaaggttaagtcagaaactcagaggtctgtgtacatttttaagacattaaaaatattgtgtaaaccaaacaaaatacttatacaggtcaaatccaaccacaggttgccagtttgcaacctctgctacagaagttctctgcaaaagtgatggcgtgagaagagttctatcctagcagataatctaaggcagcccctaaaactaagtagctccttggaagcatctcctgcaacactcagcccaactctcaccattctgattgacctgaaaaccaaattaatttggcaatttaattgagcaaaatgagcccctgctctgtaccaggtgctgaggaatcagaaatgaacagtagtgctaaagtacagctaatatttattgagcatgttctaggtgccaagcactgttttacacgttatgtatattgactcatttaatcctcacaaaaccctatgagattactattatccttaaagactgaggcgcaatgaggttttatttgtccaaggtcacacaatcagcaagcagcagtgcttaataaggacctgagacagactccaccaaaaagagctcacaatttgaaagcaagccccattcaataaatgatgctgggatcactggttatacatagggaaaaaaaatgaaactggacccgaccttacactacacataagaatccattccagatacattaaagatctaaccattgaaaacaacagtaggtattccagaatataaagaataattgcaggctgggcacagtagctcacacctgtaatcccagcactttgtggactgcttgagctcaggagttccagactagcctgggcaacatggcgaaaccccgcctctacaaaaaatgcaaaaagtagcagggcatggtggcgcatgcctgtggtctcaactggcatgggaggtgggagggttgcttgagcccaggaggttgaggctgcagtgagccgagatcgcaccactgcactccagcctcggtgacagagcgagaccctgcctcaaaacaaagaataactgcaaatcttaaaggaaaagattgataaagttgatactaaaattcagaactttttaacaaatgacaccttaaaacagatgttttaaaataagcaacaggccaggcgcagtggctcacacctgtaatcccagcactttaggaggccaagacgggtggatcacttgaggtcaggagtttgagaccagcctggccaacatgatgaaaccccatccctactaaaaacacaaaaatcagccaggtgtggtggcacatgcctgtagtcccagctacttgggaggctgaggcaagagaatcacttgaacctgggagacggaggttacaatgagctgagatggcacgactgcactccagcctgggcgacagagcaagacttcatctcaaaaaaaaaaaaaaaaaaattaaaataagcaagaaactgggaaatgacatctgtaatatctaccaacaacaaaggattaataatcagaatatataaataaatcttttgtaaaagacaacccaataaaaaaaatggcaaaacaagcccgagcattatctaatccgtgtaaagctggcactaccacagttaccacacagtacactccagaacaatagaccttgccatcactgactgatataaatattcaggggtctgtgttatgctgcaggtacacagagcatgggtaatccagcccaaagggcagagccaagacgtttattcattctctatcatcatatagacattggatggcaaattagaggttgaacatccaacactcaaacacatagatcaggggttggcaaatgtttttgtaaagagtatttccagctttgtgagctgacacaacacatctctgtcacgactactcaactctgctattggtaccacaaaagaagatatggacaatatataaataaatgagtgtggctatgttccaataaaacgttatttacaaaaacagatcgtgggccagatttgacctatggaccacagtctgtcgacctctgacatagatagttgtgctttttctacactataggtaggacacttcccatgttttcccctgtcttttatgtctgctgacacctctgatttccttaaccaaaaactacaccacacttgacagctttgcaatggtttccaaaactctattactctgccaaaaaaaccttttcgcccttattatcaatgagaattctcccctcattttcctttcacttttttttttttttttgagacggagtcacgctctgttgcctgggctggagtgcagtggtgcgatctcggctcactgcaagctccgcctcccgggttcacaccattctcctgcctcagcctcccgagtagctgcgactacaggcgcccgccaccacgcccggctaattttttgtatttttagtagagatggggtttcaccatgttagccaggatggtctcgatctcctgacctcgtgatccgcccgcctcggcctcccaaagtgctgggattacaggcgtgagccaacacgcccagacttcctttcacttttttaaacctctttgacagacaccaccccaaaccagaaatttaaaaaactccccctaagccactcacaatgtcaataatcaacacctgcaaattctaactccactcaatgcccacagcctctgccttagttcagatcctcattacttctaactctgctcagtgcccacagtctctgccttagttcagatcctcattacttctaactctgctcagtgcccacagtctctgccttagttcagatcctcattacctctctggtcttcagtctaccctccttccaaagaacatccatttatctcctagaaattaaacctccaccacatactccccttctcgaagatcttgaatgcctctctcagctaaggattcagtccaaactccttagcaaggtccttcacaaccaggttcctaacatggtcttcctagtctcatctctggccatgctttcacacacattctatgctccagccacattcagttattaatacattccctgaaaacgtgtctttacctgaaaggcccttctctccatttcactggcaaattcctgtatcttttaggacacatctcaaatgtcaccccttcgcaacaccttccctgattctttgagcagacacacccatctccgtgtccttatagcgtttaataactcttctttggcatcgaccatcctgaactatgattgttcacatgtctacttcactcatggggctgcatacccaaagtgaagtgactctgccttaaaaacttctgaagctacagagcccagtataatgcttgatatgcagtagatgccttgaggcacagtaaacgtttgctgaatggaagacatgcctggcagtaggagtagggtttcttaacctggggttcatagacaggagtctatagataggacttcagtggggcttgtgaacttggacagggagaaaaaaatctcttttactaacttttaactgaaaattaccattctattcaaatatgagtgtaggtaacataccattctagtattagcagttctgtgactctgtaacaacagaaatctcaaatatctttatatcatactacaattgttgcatataatcttgaagtagcctttatgcgcatcatgtctttgaaattataattatcggatccatcactaaatctgatttcttaacgtgctgataaacaagtatatgcatattagatttgtatattttggaaactgtattttaatataattggtgttccttataattcaatgtactttattttatacaattaaaaaatattattctgaaaggggtccatggcacagataaggtcaggtcttcctgcattagaaaaacccagaataggctgggcgcggtggctcacgcctgtaatcccagcactttgggaggctcaggtgggcagatcacttgagctcaggatttcaagaccagcctgggcaacatgttgaaaccccaactctacaaacagaaaaaaaagaaaagaaaagaaaagaaaaacccagaacaaatgaattgtgttgctgtatatacatatggtattgacagttttattttatatatgcccgcataatatttttgttcgctaattctctttgattatatggggccctggacctattttccatgactaatttgcatatttccttcagaactctcccatagcccatgcgaactttgaattcttctctaacatgatccaacttcaattaataaaatagagactctgggtgtctacaatttttcacttttcttttttaggattttgtgttcctttgtggtaaacacctagaagagaaggagcatctctcttttttttttttctttagacagtgtcttgctctgtcgcccaggcaggaatgtcatggaatgaccatagcatggctcattgcagccttgacctcccaggctcaagcgatcctcccacctcagcctcctgagtagctgggactacaagtacaagccacatcaggtggctaattttttttatttcttttgtagagatggggtctgccagctcctgggctcaagaaatcctcccaccttggcctcccaaagtgttgggattacaggcgtgagccactgtggctggccggagcacctcttaaaactctagaaagttagaaggtctcaaagataacttctttgcacaattagagatgaaccaggaaataccaaataactggctgcctatacttttttgtattcccttcagcctttgtattgccacactcattacaggaagaaaacaaatttaatagttatctggtatatactgttatgcttcatttcttgttgtttttgtttgtttgcttttagtttcatcacaagaatgttatgcttcatttcttaacacctttctcccagctagcaaattcctttaaggcaatgtgtttagtgaggaagcagccgacaatttctagtacccctctgccactaacttgtaagatcttgaaaagtcaactttacctttctatgtttcagctaaaatcactacctgatttgaaatctttacttgatctctcaggcctttgtagtttttatacattcactcttcttcaccattttactggcttcaataacgcctttctgatgacctctccaggtgactctgctcttaagctgtgggctgtccccttccagggaagacaccttgggtcaccgcccccaaacagccaggtccctccttttaaagacacacacaactccctaagttgataaaggttctctccttccttgccaaccagttccactctctgtgcctcttttgctggccagctcctgcacccaaacctcagtctccctttgtcccccttttctctcatcaaacacctcctttttcctgttgcttcccccaagagggggtggaggatgcttgggacataagtcttcagagccttgggagttatacagctttgcaattcagccccagtaccccaaggactgccccaatctgaaccagcgtctgtacccaaagggccctcattcctcatcaatcacctccttccctcccagcaaagaactgctccagccctgacagcctgagcttggcccccatgcctccaccccaatccccaggtcctacctgcattagggctctaacaccgcctaaggcctaacccagttccacgtcctgccatcctctcagcccatagaccccaatcccggttcccttcggacccagtgttccttctccgcgaccctgaccacgaccccacgaccggctcccgcctgttccccaggcctggagcgccaccccgtgcagaccccggccagccctgcactccctcagtgcaccggcccccgcgcccagcaccctccccacccagcccggccgccgctccctccagcgcccccgcccgcaggcctggggcccgctccccaacatggcgacggggacacaagcgcggcgggcggggcggctccgggccgggcccgctctcagaccgtgccactcggtcgcccggcgccatttttccgcgcgggcccgggcggcgcctcctccccgcgaagccagcccgacaaggaccgcggacgcccggcgggcccaccccttacgggcccgcgccgccgtcccctcacctgagcgcggccccggccctcccgggcgggccttggagcgccggcccgggccgtgcgtgcccgccgccctcggtgcgtccgtccgtcagtcctcgcgtgcgcccgtctgtcccgccgcccgcgcccggccgcccgcagcccgacccggcagggcctcacggagccggcggggagggggatgggccggaccgggccggggagggagggggagggagggagagagggagggagcgcgagagggggcggggcggactcgaggggcggggcattgcccacgtgaccagacgtccccgggagcgcgaggtggagcgcgcgccagctcccttcggtgctgagtgcttagtgctgggatctcgtgggtctctgtcggctttccagggctattctctcgccagtgagtcccacttcggaagcacacattgcacagtcttttgcgagcgctctgagtatccttggacatggcaactccaagcctcagtttacccatctgaaatatggggaaaatcatagtgcttgtgaagagcaaatggaggtgggcttggaaagcacttgtcaccgtgcctgacacatactgtctaataataagcttaatgggatatagataaaagctttcattattatttgcctctaaatccctctcttctttttcccatcattacctccctagcaagctaaaatgctcagtaaatagaattattgatcgaacgagtgtggcccctcccctcttcccaaacgtagaaaggcctcctcagcactggacttcatgtctgtcatacaggcctggattcatatctggctttcactcttttttaaaaattttctgttttttcccacactacactgatgtattttttaaattttcgtaagtacgtagtaggtgaatatatttatggggtacatgagattttgatacaggcatgcgatgtgtaatcacatcatggtaaatggggtatctagcaactcaagcatttatcctttgtgttacaaataacccaattatactctagttattttaaaatgtacaagtaaattttgtgtgtgtgtggttttttttttgttttttgttttatttttgtttttttgagacggagtctcactccgtcgcccaggctggagtgcagtggcgcgatctcagctcactgcaacttccgcctccctggttcaagggattcgcctgcctcagcctcctgagtagctggtactacaggcgcatgccaccacgcccagctaatttttgtatattttttaagtagagatggggtttcaccatattggccgggctggtcaggaactcctgacctcatgatccgcccgcctctgcccctcaaagtgctgggattataggcgtgagccaccgcgcccggccaattgttttttactgtagtcaccttcttgtgctagcaaatactaggtcttattctttctaactattcttttgtacccgttaatcattcccacttcccacctacctccccattaatcttaccagcctctggtaaccctccttctattctctatctccatgagttcaattgttttaatttttcgctcctggcccggcatggtggctcacgcctgtaatcctagcactttgggaggccaagatgggcggatcacctgaggtcaggagttcaagaccagcctggccaacatggtgaaaccctgtctctactaaaatacaaaagctaggtgggcatgatggcgggtgcctgtaatcccagctactcaggaggctgagacgggagaatctcttgaacctgggagatggtggttgcggtgagcctagctcgcgccactgcactccagcctaggtggctgagtgagactccgtctcaaaaaaaaataaaaaatagttaattttttgctcccacaaataagtgagaacatgtgaagtttgtctttctgtgcccggcttctttcacataacataatgacctccagttccatccatattgttgcaaatgacacgatctcactcttttttaatggcggaatagtattccattgtgtatatgtacattttatttatccattcatctgttgatggacacttaggttgcttccaaatcttggctgttgtgaacagggatgcagtaaacatgagagtgcagatctcttccatacactgatttcctttctttccggtgtatacctaagaatgggattgctggattgtatggcagctctctttggctttcgctcttgatagctgtccttgcctctctgaacttgagcatcttcatctgtaaaatgggagttggggtctgttctgagcatcccaggagatagaggatgagcaggtggattgtaaactaattaaacaaatcagtcctactgatcccatagaagaaagggagtcaggaaccctttcattccatcaatatttattgagtacacacagtgtgcttggactggtgtagtagatacccaccatcttttcacattaccctgaccgccctctaatctattctccaccctgctgtcagagtaatgtttctaatgatcagaaatatgatcatgtcactactctacttaaaagtatctgttgatggccaggtgcagtggctcacacctgtaatcccaacactttgggaggctgaggcaggtggattgtttgagcccaggagttcaagaccgggctgagcaacatggcaaacgctgtctcaacaaaaaatacaaaaatggctgggctcagtggctcatgcctataattccagcactttgggaggtcgaggtgggtggatcacgtcagctcagaagttcgagactagtctgggcaacatggcaaaaccccatctctactgaaaatacaaaaattagctgggcatggtggtgcacacctgtagtcccagctaatcgggaggctgaggcatgaggcaagaatcacttgagctggaaggtggaggcttcagtgagccgagataacaccactgccctcctgcctgggtggcaaagggaaaccgtgtctcaaaaagacaacaaaagacaaaaacatagcaggcatggtgctgcacacctgtggccccagccactttggaggttgaggtgggaggattgcctgagcctgggaggttgaggctgcagtaagctaagatcatatcattgcactccagcctgggcaatagagtgagaccctgtctcaaaaaaaaaaaaaaatctgatggctctacattgctcttaagataaaggccaagccgggcgcggtggctcacgcctgtaatcccagcactttgggaggccgaggcgggcagatcacaagatcaggagatcggaccatcctggctaacacggtgaaaccccgtctctactgaaaatacaaaaaattagccgggcgtggtggcaggcgcctgtagtcccagctactcgggaggctgaggcaggagaatggtgtgaacccaggaggcggagcttgcagtgagccgagatcgcgccactgcactccaggctgggcgacagagcgcgactccgtctctaaaaaaaagataaagaccaaataaatgttggcctccccacatctctagatttatcttagggccctcttcccctttctctgggttgcaactacagtgatatttcttacacattgttctccctcctttctgagaacccttgcacatgctgatccccctgcctgcaatgctctccccacttagataactctcagtcttcagatcccagttcaaacggggctactccaaggataccttccctgacccattcccacacaggttttcttagcacgatatgcttgtccttagtagaatacactgagtcattattacctgtctttgccactagactatggacaccataaggaagaaaaccttatccatcttgtttaacattgttttctcagcatatagcacagcacctggcacagagtaggtgctcagtaagtatttgttgcgtttgtgaatcctaagcacaatactaggtattgggcccaagagggcagacaggagcaaagagaaccacaggcaaccgcaacaggggggcaccttagacctttgagcctatgaaattaacaccaaataaatttaaaatatcctggaaaaaaaaacttttctgaagctttttattttaacttttaaaaactgaaatataatttatatacaataaaatgaaaaactattaagtgtatatctaataatttttttgcctacattcctgtgttaccaccacctagatcaagttatagatctatcaacccagaaagttcccttttgttctcttttgtatgttctcttctaataaatacctgctcccccagatgtaaccattattctgacttctagcaccatagattaactttttttttttttttgagatggagtcgcgctctgtcgcccaggctggagtgcagtggcacaatctcggctcactgcaagctctgcctcccgggttcacgccattctcctgcctcaacctcctgagtagctgggactacaggcacccaccaccacgccaggctaattttttgtatttttagtagagacggggtttcaccgtggtctcgatctcctgaccttgtgatctgcccgccttggcttcccaaagtgctgggattacaggcatgagccaccacgcccagccgtagattaactttgacagtttttgatctccatagaaacagaaccatacagtttgtactcttgtgttagcctggaaatctgacatagccaaagggtgattttttggataaagatacaattaatgaatgacttgattaattaacctgaaagactgaatgaaaagctctggctacttcatcctacagacacagaggtcctgacaacagccagcccagaggctgagaagacctcactgacatatttccaaacccacaaagacttctagagataagaaagctctcaaagattccagaaactcagcaataagactgggtgctatggctcatgcctgtaattccagcactttgggaggccaaggcaggaggattgcttgagtccaggagtttgagaccagcctgggcaacacagtaagacttcatctctacaaaaaatttaaaaattagctggtcatggtcgtgtgtgcccgtaatcccaactactcatgagactgaggtggaaggatcacttcagcctgggaattggaggctacagtaagccaagatcacatcactgctctccagactgggtgacagagtgagaccctgtctcaaaaaaaaaaggcaaaggacttgaatagacatttcttcaaagaagatatacaaatggctaataagcacatgaaaagatgttcaatctctgtagtcattaaggaaatgcaaatcaaaaccacaatgagataccaattcataccctatttatgtatgtatgtatttatttattgagacagaatctcactctgtcgcccagactggagtgcagtggtgcgatctcagctcactgcaacctctgcctcccaggttcaagcaattcttgtacctcagcctctgaagtagccggaattacaggcgcgcaccaccatggccagctaattttttgtatttttagtagaggtggggttttgccatgttgtccaggctggtctcaaactcctgagctcagtcattccccctgccttggcctcccaatgtgttaggattacaggcgtgagccacggcgcccagctgctgttatttttttaaaaggcagaaaataacaagttttggcaaagatgcggagaaattagcacttttatgcattgctggtgggaatgtattttgtttttgttttttgtttttctttgagacgatctcgctctgtcacccaggctggagtgcagtggtgcaatctcggctcactgcaacctccgcctcccgggttcaagcaattctcatgccccagcctccagagtagctgggattacaggcatgcgccaccatgcccggccaatctttgcattttctgtagagacagggtttcaccctgttgcccaggctagtctcaaactcctgggctcaagtgttccacctgccttggcctcccaaaatgctgggattacaggcgtgagccactgcgcccagccaggaatataaattgatgcagccatggtggaaaacagtttggcatttcctcaaaaagttaaacataggcgcccctgtaatcccagctacttgggaggctagggcaggaggatcacttgaacccaggagtttgagtccaccctgggcaacatagcaagacccagtctcaaggaaaaaaatgttaaacataggattaccctatgagccagtaattccacttctgggtattcatccaaaataagtgaaatcacattagtaccactgtactccagcctgggtgacagatgagaccctgtctcaaagtttaaaaataaataaatgaacaagccaggtgtggcagcacatacctgtggtcccagctacccaggaggctaaggcgagaggatcagttgagcccaggaggttgaggctgcagtgagccatgtttccattcctgcattccagcctgggtgatggagcaaaaccctgtttcgaaataaaatttaaaaaataaagaagtgaaagcagagtttcaaagagatatttgtgcacccctgttcacagcagcattgttcacaatagccaacatgtggaagcaacctacatatctatagacagttgaatagataagcaaaatgtggtctatacatgcaatgaagcatcgctcagccttcatgaaggaaggaaattctgacccgacgtacaccacagatgaaccttgaagatattatgctaagtgaaataagtcggtcacaaaaagacaaatattgtatgattcctcctatatgaggttcctaaagtagtcaaattcataaagacagaaagtagagtggttgccaagggctagagggagagggaatgggaagtttgtgtttaatgaatacaaagtttcagttggggaaaacaaagttctggaggtagatggtggtgatggttgcatgtgaatatacttaatgccaccgaattatatgcttaaaaatggttaaaatggcaaattttatgttatatatgtattttaccatacacacgcacaaaagattccagagccactatcctaattttttcaccttgttgtccatgtccttaagccaagggtcatgggtgttcctgggatctgcaagaatgcaaagagctgagaagacaggggcgcattgggcacctgcagatcctgtaggtaaaaatagcaggagcctaggcaacacaaatacttgttgcctgcaggcaggcagcaaaagaacaaaaacaggccataaactagcagatagtatagcataatgattacaatattgggctctgaagccaaagtgaatctgaacacccaagttcagattctagctctgccatttattagctatgtgaagaaactgcaaccaaaaggagataaatgacttgtccaacagggtccaaagtattttctcatttatattgtttaaaaatctttacatgggttttgtttcattctatatccccagtagactgtaagctccccaaggaagctatgtttgtaatatcctcacttgaaatgtaacttaacttctttgtgcttcagttgcctcacctgtgggatgcagagaataagggctcctacttcataaggttgtcaagcatattaatgaatttatacctataaatgtttaggagaaagcttagtgcttatgatagtctcaacaagcaatagattgagagaggcttctgaagaggtggtcaggctatttcataaaatgttttgagcaagaaaaacagtcctaaaacatccaggattgttctagatttggactagagtgaagaaaaagcaaatcaattgttctttgataatttgatttgtatttattggacttctactttcatgtgtgtccaaacaggctcaagctctgcagtgataagactgacagtgaatacttcaatgatgtctttaagaaaaacaataataaaacaggggaaaaaagaaagaacaaaaccatctagaaagtgtcaacattttactgtctgcagggttcgtcacaacagtgccaaatgacaaacttaccacatttagttggatgaattttgccctgcagaaggatatcaccttttttttttataggcaaacagtttatttattcatcctccttctcttcctccccatcttcttcatcttcttcttccatcttttcccaggcaactttagcaggaccttttgtgccgtccaactttcctttcgacttatagtcagcaacatccttctcatacttcttcagctttgccaccttagtgacataaggctgcttttcactgtcatttaagttattccacatctcacccagcttttttgccacgtctccaatagagatgccagggtttgtggatttgatcttggggcagaattctgaacagaacaggaagaatccagacagtggccttttgggggcattaggatcgttcttgcctcccttagctggtccataatccttcatttctctatcacagtgcactttatccgcctttgccatttaatcgaatttagactctctctctctttttttttttctgagatggagttttgctcttattgcccaggctggagtgcagtggcacgatctcagctcaccgcaacctctgcctcctgggttcaagccattctcctgcctcagcctccccagtagctgggattacaggcgcccaccaacacgcccggctagttttttgtatttttagtagagacgaggtttcaccatgttggccaggctggtctcaaactccttacctcaggtgatccacccaactcaccctcccaaagtgctgagattacaggcgtaagccgccgtgcccagcctagacttctctttcccagacattgtcttccacctctcagagcactttttggaaaattctgcaaaattgacagggacctctggatttttcttatgctcttctctgcacgtctgcacaaagaaggcaaaagcagacatcttgccccttagtttcctggggtcacttctagccatcctgactgtattgttcactagtcttgaaggatatcacttttaagtggacaccattcacatgacattataatttgcaaatttattatgataatttaccagtagatggcagtaaaatgccttgttatttcagaatctgttcgttgtaacaattttcagatatatggaaataaaatgccttgaggagggggtcacttgtgctttgcataaagacatgctatggcgaggcgcagtggctcatgcctgtaatcccagcactttcggaggtggaggtaggtggattgtgtcagcccaggaattagggaccagccagggcaacatggcaaaaccccgtctctacaaaaaaatacagaaattagccaatcgtggtggtgcatcatgcctgtagtcccagctccatgggaagctgagatgggaggatcacttgagcctgggaagcagaggttgcagtgagctgagactgcaccactgcactccagcctggatgacagagtgagactctatctcaaaaaaaaaaaaaaaaaagcggtggtggggtgggggcttactatgggcaagccatggcttgctcttcaggaaaaaaatcattgaaaaaatagaagaaatagactaataattacacaattttaaaaagtggaagaatatcaagtgaccatacatacacaaaaaggtgggggtgggggagaaaaaaaaaactgttttcaaaaatattctgaaattttaaagctttttattagagtataatataaagacataaaagtacagaaatcgtaagtgtaaagcctgttgaatttccacaaagccaacacacatgtctaacaaacacccaaatcaagaaatagaacattcagccccacagaagccccttccagtcattacccacagcccccaaggttaaacagtattttaacttctaactccatagattagtctcaccaggagttaaacttacagattcatctacattgttgcatgtagttgtagcatgttcattttcattgctgggtagcatttcattatttattttttatttttttgagacagagtcttgctctgtcacccaggttggagtgcagtggtgggatcacaggtcactgcagccttgacctcccaggctcaagtaatccttctgcctcagcctccctagtagctaggaccacaggtgcatgccactacaccatgctaatttttgtattttttgtagagacggggtttcaccatgttgcccaggttggtctcaaactcctgggctcaagtgatcctcccacctctgccacccagagtgctgggattacagatgtgagccaccacacctggccagcattttattgtttgaatacaccataatttatccattctactgttaatgagcatgtgggtttccacttaggagctattttattttattttatttattttttttagagatggactcttgctctgtcacccaggctggggtgcagtagtgcgatctcggctcactgcaaccttcgcatccctggttcaagcaattctctggcctcagcctcccgagtagctaggactacaggtgcacgccaccatgcccggttaatttcttttgtattttttagtagagacagggtttcactgtgttgcccaggctggtctcgaactcctgagctcaggcaatctgcctgcctcggcctcccaaagtgctaggattacaggcgtgagccatcacgcctggccagagctttttttgttttgttttgagacagagtttcgctcttgttgcccaggctggaatgcaatggcgtgatctcggctcactgcaacctctacctcctgggttcaaacgattctcctacctcagcctcctgagtagctgggatcacaggtgcccaccaccatgcccggctaattttttatatttttagtagagacagggtttctccatggtggtcaggctggtctcaaactcccgacctcaagtgatccgcccacctcggcctcccaaagtgctgggattacaggcgtgagccaccgcacccgggccggagttattttaaattttactactatgaacattcttgtgcatgtctttggatgaacatgtgtacaattttttgctggataaaaacctaggactaggattgctgggtcatagagtttgcattcagctcttagctcatattaccaaatcctatgtctttttaaaacagttttattgacaggctgggcacggtggctcatgcttgtaattcaagcacctttggaggctgaggcgggtggatcacctgaggtcaggagtttgagaccagcctggccaacatggtgaaaccccatctctactaaaaatacaaaaattagctgggcgtggtggcgggtgcctataatcccagctactcgggagattgagggaggagaattgcttgaacctgggaggtggaggtaacagttagcagagatcccgccattccattccagcctgggtgacaagagtgaaactctgtctcaaaacaaaaatcaaaaacaaacaaaaaacaattttccaaaacaaaacaaaaaaacagcttttgagatataattgacatactatacaatttactcatttaaagtgtattattcagccgggtgtgtggctcaagcctatgatcccagcactttgggaggttgaatcggttcgctcacatatgtccaggagttcgagaccaggctgggtgacatggtgaaaccccatttctacccaaaatacaaaaattagccggacgtggtgctttatacctgcagtcccagctattgtggagactgaggtgggaggatcacttgagcccaggaggcggagtttgcagtgagccaagactgcactattgtgctccagcctgggctacaaagccagaccctgtctcaaaaaaaaaaaaaaaaaaagtataattctatggtatttagtgtagtcacagatatgtgcaaccatcaccacagtcaattttagaacattttcattgcctcagaagaaactctataatctttaggtatctccctctccccaacccccccattccctcagccctaaggaatcactaattgactttgtctctgtcagtttgcctattatggatacttcatataaatggaatcatacaatatgtgaccttttggcttctctcacttggcacaatgttttcaaggttcatccatattgtagcatgtatcagtatcagtactttattctttttcatagctgaataacataatatgtattattatgtgaatataccacattttgttatctttttgtctgttgatggacatttgggttgttttttaccttttggtattgtgaatagtgatgctatgaacattcatgtacaagtttttctttgaacacctgttttcagtgatttggggtttatgcctgggaatggtattgctgggtcgtatggtaatttggtttgtcttattaaagaaatgccaaactgttttccatagctgctgtaccattttacatttccaccaacaacgtatgaagattccactttttcacatcctgagcaacatttgttatttcctttttaaaaaattattgttgtgggcgcacagtggctcacacctgtaatcccaacactttgggaggctgaggcaggaggattgcttgaggccaggagtttgagaccaacctgagccacatagtaagactccatctctatttaaataaaagataaaaaataacatttaagtaaataaacaaataaaaataatatttatggccagtctaattgttgtgaagtggtatctcatggtgattttgacctgttttaatctacatttccctagtgattatgatattcagcatcttatcatagacttatctttgaagaaatgtctgttgaagcccaggcacagtgacttacacctgtaatcccagcactttgggaggccaagatgggaggattgcttgagtccaagagttccagaccagcctaggctgcatggcaaaaccccatctctacaaaaaatacaaaaattagctgggtgtggtgacatgcacctgtagtcccagctactcagggggctgaggtgggagaatctcttgagcctgggaggtggaggttgcagtgagccgagatggtgccactgcactccatcctgggtgacagagtgagactctgtctcagaaaaaaaaaaaaagtgtcctttttgttttgttttgttttgaggcagggtttcactcctgtcacccaggctggagtacaatggcacgatctcaactcagtgcagcctcgatctcctgggttcaagggatcttcctgcctcagcctccccagtagctgggactacaggcacgtgccacagcacccagctaattttttatatttttggtatatacagggtttcaccattttgcccaggcttgtcttgaactcctggactcaagcgatctgcccaccttggcctcctaaagtattgggattacaggcatgagccactgaaccctgccaagaaatgtctattgaagtcctttgcccatattttaattgagttgtttgtctttatgttgttgaagtgtttttaatatattctgggtactatataaagtactcagatcagatataagattgcaaatacttttcacattttttggactgtcttttcactcaagattgtccttttatgtacaaaactttttaatttcaatgacatccaattatctatgtttgcttttgttgctgtgctttcggtgccacatctaagaaaccatttgccaaatccaaggtatgaggatttacccctatgtttccttctaagagttttatagttttagctcttatatttgtgtctttgatccattttgagttactttttgtatgtggtgtgaggcaaggttcaaacttcattttgtgtatgtgaatatgttaaagagaatattccttcttcattgaatgatcttggcaccctagttgagatcaattggccatagatatattgatttatttctggactatcaattatgttccattgatatgtttatccttatacctaccacactgttttgattactttgtagtaagttttaaaatcgggaaatgtgtgtcctccaacattgttctttttcaagattgttttggctattctgagtcccttgcaattaattccatatgaattttaggatcatccatattcatttctgcaataaagtgctgctggaatttccatacagattgcattgaatctgtagatcaattgggaagtattgtcatcttaacaaaattaaatctttcgattcataaacacagaatgtctttacatttatttaggtcttctttcatttctttcgacaatgttttatagttttaatttttatacttcttttataaaatttattcctaagtattttattctttctgatgcttcagtaaatggaattgttttctttcttttttctttttcttttctttttttttttttaagggtctcactctatcacctaggctggagtgcagcggcgccatcaatccaccttctggcctcaagctattctcccacctcagcctcccgaggagctgggactataggcacacaccaccactgtcagttaatttttgtagagacaaagtttcaccatgttgcccaggctggtctccaactcctaggctccagcaatcctccagcctcagtctcccaaagtgttgcaattccaggtgggagccactgtgcctggccagaattgttttcttaatttcatttacaggttgtttattgcaagtgtacagaaactttatactgatcttgtattagcaatcttgctgaactcctttgttagctgtcattgttttcattgatttcttaggattttttgtatacaagatcatgccatctgcaaataaaaatagttttactttttactttccaatctggaggccttttacttctgtatcttgcctaattgccctgactagaacatccaatacaatattgaatagaagtagcaagaatgggtatgctctaatcttagtgggaaagcatccaatctttaactattaagtatgatgttaactgagggttttttatatttgccttttatcatgttgaagaagttcccttctattcctggtttgctgagtgttttttgtttgtttgttatcatgaaggggtggtaggattttgtcagatgccttttctgcatctattgagatgatcatgtgttgttttttattctaccaaaaaaatataatgcaatacttgatttttgaaagtaaaccaagcttgaattcctggaatgtatcccactgaggcagtgtatacttctttttatatgttgttggctagtattttgttgagtatgttacatccatgttcataaaagaatattggtctgtagttttcttattaggtcttattttgttggattttaatttcaaggtaaaactagcctcacagaataaactagaaagcgtttcttcctcttctatttattgaaagctttttttatagaattggtattaatttttttcaatgttttgtagaaatcactagtgaggccgtctgagacctgggcttttctttgtaagtagtttgctttttagtatatattactaatctctttatttgttatgtatctcctcagattgtctatttcttcttgagtcagttttggtatgtgtctttctaggaaattttatgtttcatctaagttatctgatttattaacatacagttgttcatagtatttctttgtgatccttttttatttctgtaagattgtaagtactgtcccatctttaatttctgattctagtaatttcgagtcttctttttttcttgatcaatctgggacaggtttgtcaattttgttgattttttcaaagagccaggatttggttttattgattttctctattgtttttctattctctatttcactaatctctgctccaatctacccagtttatgatattttggtatggcagcccaaatgaactaagacactctgtcacttgaaagacagcctgggagagtaggtatgactacaggcatggctcaggcacctaaagatatcagggcaaggatcacccaaacatccatcaaaaggaaactggttaaacccttcagtgaactacgatgcattattataaataatgaagtggatccatatatattaacaggggaaaatgcccacgctctattggtaagttaaaaaaaaaaggaagttgtagacagtgtgaaaatatagtcccatttttactttttaaacagaatatatgttagtgtacagaaaaaagttggaggaatgtgtattaaattattgacaatgagatttttggagggtttggattttgaaggggtggattacagatatacattatatatctataaagtatttgatatttgaaaaactgttatatctgcaatccaataaaataatttaaaaatttttaaagaagtggccaggcacagtggctgaagcctgtaatcccagcactttgggaggccaaggcaggagaatcacttgaggccaggagttcaagatcagcctgggcaacatagtgagactcttgtttctacaaaaaaatgaaaaattagccaggtgtggtggtatgcgcctgtagtcccagctacttgggagtccgaggcaggaggattgcttgaccaggaaagttgaggctacagtgaacagggattgcaacactgcactccagcctggatggcagagtaagaccctatctctaaaaaaaaagataaagaaacgaaggggagggaagggaagggaaagaaggggaaagaaagggagggaaggaaggaagaaagagaaagaaggaaagcaaaagagagacagtgagacagaggggaagggaaggggaggggaaggagaggggaaggagagagcaaggagaggggagaggaggggaggagagggaagggaagggaaacatagtctatggagtcgaacagatggcttttgaatcatggatctgtgaaaggaggggaaggaagggagaaaagaagaaaagagaaaggtaggaaggaaggaaaggaaaagaaaaagaaagaaagaaagagacatagtctatggagtcaaacagattgcttttgaattatgcatctgccaactaccagctgggtgatctctggtaagttgcttcgggtctctcaattttctcatcaataaaatgggggaattaataccagcctcataagaatgagctacctatctcaccagtttcatctcatctcatcatcccctcggggtgctctagtgtaggggtcagcacactactgcccttatagcagtaagggtctggtttttgtttgtttgtttgtttgttcttgagacggagtctcgctctgtcacccaggctggagtgcagtggcgcaatctcggctcactgcaagctccgcctcccgggttcacgccattctcctgcctcagcctcccgaatagctgggactacaggcgcccgccgccacgcccggctaaatttttgtacttttagtagagacagggtttcactgtgttagccaggatggtctcgatctcctgacctcgtgatccgcccgcctcgtgcctcccaaagtgctgggattacaggcgtgaaggggtctgttttcagaaaataaagttctggcggggcgcggtggctcacgcctgtagtcccagcattttgggaggccgaggtgggcggatcacgaggtcagaatatgaagaccatcctggctacacggtgaaaccctgtctctattaaaaaaaaatacaaaaaaaaaaattagctgggcgtggtgggctcctgtagtcccagctactcgggaggctgaggcaggagaatggcgtgaacctgggaggcggagcttgcagtgagctccacttgcaggcagagcttgcagatcgcgccactgcactccagcctgggcaacagagcgagactctgtctcaaaaaaaaaaaaaaaaaaaaaaagaaaagaaagttctattggaacacatccacagccatcaggatgttgtcttacacattgtctatggctgcttttgcacttcagcaacaaagttgagtaattactacaggaaccatatgacctacaaaatctgaaatatttactctctggtcctttgtaggaaaactctgccaacccctgctctaggaagaatatataggccttctttcacctcctaaaacatgacacattccttctcaccacaatacctttgaacatactgttccctttgcctagaatgacattcccacatcccatatctaatcctttcctgtcaatcctattcattctcatgaccttctcagggaagcttttgcggatcctcaaactagattaactttcttgatatacattctcttagtatccctcatagagtttattgtgatggcaattacccgaattatctgtgctcttatttctttaacatttgactgccccgatagactgcaaacccattaaaaagtctgtcttggctaggcgcggtggctcatgcctgtaatcccagcactttgggaggctgaggtgggcggatcacctgaggtcgggagttcaagaccagcctgaccaatatggagaaaccctgtctctactaaaaatacaaaattagccaggtgtggtggtgcacgcctgtaatcccagctactcaggaagctgaggcaggagaatcgcttgaactggggaggtggaggttgcggtgagctgagatcacgtcattgcactccagcctgggtgacaagagcaaaactgtctcaaaaaaaaaaaaaaaagaaaagaaaagcctgtcttgttcagtgctgaatctctagtgcctaacaaagtacctggaatgtaatggatagaagaatgtatgcatgaatgatattatctataaaaggtatttattgtctgatatatactatatgacgtatactttataacaaagagttcaactaataggtgtggaattggttaagagcacaaattccagagttggacatgctgagatgaaccccagttcttccatttaatagatgaagaaccttagacaagtcccttaacctcttttggcctgtttcccatctgtaaaatggcaataatattagtacctacttcatgaggcttgtaataaagattagatgctatatattatagttattggtgttatgaattattattattggtgcatgtcttagctggacagatattattatgagtccttcaacgttgactccaggttactcttgaatcggttactgggacagggtgagccgaggtctcctctcccactcccactctcaacccagttaaatataaattaaaccagagccatggttaagcaacattctttctttaatttccctttgcaaatggaagcccctgagctggtgcccacccccacccctaccccataccctggggacccccgatgcaaggcccccacctcaacctggtgggaaaagaggagcaccccctccctatgatggtccattaaaaaattcctagtcatttaagaaatgaggctgggaatgggagaaaggaactggaagacaaggcccaggtcaggccagtctgaagatgttggggttgtgagacccttgagaagggtttgcaagcacatccctaagctcggggccagcatggctgaaggaggagaggtgacacacagacagatagtctgattcctcaaggtcctgcctgcctggctgtactgtagatgctgacactcaccaccaccaccaccaccaccaccaccaccaccaccaccacaggcctcctgatggagaattttccagttactctgggattgggtttgctaagcatcccctctggcccctgatctggggcatccctggggtccccctgagaccaaacctgggagaaggagggactctgggaacatgcaaagtgggggagcagagaccccgccccaccccgctgctctacaggatggtggctccagctgcatctgggctccgagggtccttaacagcgatgatgaagttgttggtccttcggctgccatggacccaggataagacatctactttctccacgtggtgacccctggcttccaggaactcaatctcttcctctgtgaactcacctgaaaaccatccccgacatatacacattcagaatgtacagagcactagttcaagagtcctacagtcagacctgagtcctcatcctggctgctccaccacagagctgtatgaccttggacaaatcactttaccttgctgagcctcagtttcctcatgcataaatagggattatatgagaacatgaagttgcagggactaaaggagataatgcacacacagcactgaaccttgcatacagtaagtgatcaataatatgcagtcattcttaatattgaaaacaggacaggccgggtgcagtggctcatgcctgtaatcccagcactttgggaggctaaggtgggaggatcacttgagcccaggagtttgagactagcttgggcaatatagggagaccccatctctacagaaaatttaaaaattagctgagcgtggtggtacatgcctgtagtcccagatactcaggaggctaaggtaggaggatcgcttgaccctgggaggcacaagttgcagtaaagtaagctgagattgcaccactgcactccagtctgggcaaaagagcaaaaccctgtctccaaaaaaagaaaagaaagaaaatggaaggaaggaagggagggagggagggaggcagaaaaaagaaaaaggggctttgtgggtcttcatctccacctgccaaagtcaagctgccatcattacttgccaggatttctgcataatccactaactggtctccctgcttccagccctcccttccttccttccttactggtctccctgcttccagccctccctccctccctcccttcctttctttctttctttcttttttttgaggcggagtctcactcttgttgcccaggctggagtgcaatggcacgattttggctcacctcaacctctgcctcccaggttcaagcgattctcctgcctcagcctccccagtagctgggataacaggcttgcgccaccacacccggctaattttctattttttttttttgtagaggtgggggtttatccatgttggtcaggctggtctcgaactcctgacctcaggtgatctgcccacctcagcctcccaaagtgctaggattacaggcgtgagccaccgcgcctggccccctgcctttcttatagcctgttcaaacagcagccaaggggatccttttaaaccattagtcagaccttgtcacctcccctgctcaaagccctccaacagcttcaacggaatttagaataaaatccaaagtccttaccaaggtgcctctaagcccaacattgcttgggaccttgctacttctctaaattcctcccctcatttccttctatttctcaccttgcttaactgtattccagccacattgacctccttgctgtccctttagaaggccaaacatgtttctacttcagtgcctttgcacttactgttctttctgcctggaatgctctcctagaaagtcacactgctggcccccttactgctatccagtctttggcacctcttcaagaatttcctccaccattacctaaaacagcagtccctaccatctttaccttgtttggttttcttccaaagtacttactgctacctgtatttgtttatttatttactgtgtctccctccactagattataagctttttgaagttaggaacgttgtcttgtttgctattgatctccagtgacagggtcagtacatagtaaatattgagcagatacttactacatagatgaacaaatccccatcccattggataagttcagaccctcatcatctcttgcctgggccatatcccagctgcttctcatatttccctgacttaaattctcctcccctcaatctacctcccctaaataagacaaatcaggtcatgtgtctccccttcccaactggataatcttaaggctgacctctgtgagaagccctgtaactccacatcctaccgcttctcaataaagatctagtcttcttctttccctaataggaagacttttggtagctcttgagatgaagacccaatcttgaatagcattaaatcacttaatcgaaaatctatttcctttgtggttcactttcaatccttttgattatggcaaggaacaagtttcagtctgctctctaacgcttcctaatctccttctttaatggagaaagcagtctcagagccttccatgggcaacaatatttaactaaaaactacacatatctatttgtatagctaacaaatagatgatagctatttgtcatctatttgtggcaaatgatgtcatttttccatttgtgattatgatataaggtctatttttaaaatacatttagggccgggcatggtggctcacgcctgtaaatccagcacttcgggaggccgaggcaggcggattacttgaggtcaggagtttgagactagcctggccagcatggtgaaaccctgtctctacaaaaatgcaaaaattagctgggtgtggtggcatgtgcacctgtattctcagctactcgggaggctgaggcacgagaatcacttgaacccaggaggtggaggttgaagtgagctgagatcgcaccactgcactccagcctgggtgacagagtgagactctatctcaaaaaaataataaaatacatttaggctaaaaaggaagttcatttagagagacatgttatgtacatattggtttagatggtgtgcaaatgtggcaaaagtcacaaaggtgctgggtaaattgagaactctaggaaacaacagctagcctcctggctgctctctgagccattcattctggtttttgcctaggctgttcctcctgtccagaatgtcctttacctccacataccaaattcctactcatacttcaaagccaagctacttgtcacctcctccataaagcctccccagggcctcaggtagatgaactttcccttcaccaagcccccactccttgtacctccatcttacactaaggccctgaaggcaggactgggctgagcccaaataacttagcacagagcctcacattcaacagagaccagcagatatttgttgaacaaaattcaatttcaaggatgtggccttgtcatctatcagctgggatccaagtgtcgctggccaaccacaggatgtgattgttgaagatcgcggtctctgcttctaatgtgattcagtccaggagatatcaagagctgtgcagtaaagaatagagtctttggtatcagccaggtgtgtgtcctaattgaagttctgccacttagtggttgatctttgactagtttataacttctgtgagcctcagtttcttcctctatagaatggggataataatattgaacaggcaaggactgtgtctcaatcaattctgtattcttttggactcgtgtcatattaatacattgtctgttataataaaaactcctcaaaggtgcagatactttcctgtttataaaattcagctgtgccaaaattaagcccttttcttagaggaaagtccgtctcctcaccctaaggtccacgatccggcgcctgcctgcctctctgatctaatttcatccttgcttaccttggtctcctttttagtcctcaaactcaccaaacccactcctgccctgagttctttgtacttgctcccctgacctacaaagctctgcaccaattctttgtatagtgggctctctcttactttttttttttttttttaggagataggatctcactctgttacccaggctgtagggcagtggcgtgatcttggctcactgtaacctctgcctccctggttcaagcaattctcctgcctcagcctcccgagtagctagaaccacaggcacgtgccatgcctggctaatttaaaaaaatttttttatagagacgggggggtggaggggggtctcactatgttactgaggctgctcttgaactcttggcctcaagcgatcctctcacctcagcctgggattataggtctgagccattgcacccagtttctttctcactctttagatctcagcttaaatgccaccaaagagaagtcttccttgatcattgagtccgtcctattatatcaccctgctttgacagttggcagagcatttatttgtctcatatttctttgatgacttattttcttgtttgcctgtaaatgcagaatccccagcacctaggatgatgcctggaacacgtacgtgttcaatacaaactgttgagtaaatgaaagtttgaagaatgaacaactgtgtcttattttacaaatgagaaaactgaggctcagagttgagacatggatttcccaaggccacacaaccaggaaatggcaagactggttccaatccccagatcgttcactgctccaatagaaatttgccaaataaaaccaaacttcactggcagttggtgctggttgaggcatgggcacccttgggaggagtcctttctctacctgtccctgtgcccgccccacgaggtctctgctctgcactcactgtccacctgcaggaggttggactgcaggtccgggtgtaggcggccgcgggccaggctgtcactcaggttccggttcaaggtcaggacattcagcagaacctgtggtagccaaggtacagaaaaatcagggctgtcccaggggtgatggtccaggattcctcagctctcacccttggtccaggctccttagtcttgagaattcttacaccgggtgtcatctgagcctcctaacagccctggaagacaggcaggcctgtgatgactgtttccatttcacagagagggaaagtgaagtccagcaaggaaaatgacttactccagagtttagaggaagccagggaagatacaccactagaaccaagtctctttaatctagcccggggctcccttcttttctctctggatagggcaaggttaatagctaggagtggtctagggcacaatgtgggtgcttttaacttagtggttaggagtgtgcgtaggctctggaaccaaactgcctccctgctctttctagctgaaggtacttgacctaaagtcttaacctctctgggcttcggtttccttatctataaaatagaaataaggattctctccagaactgggaaggttaaaatggttaacacacataacacagtgcccagcacttagtacgaactctttaaatgttagctattgttattatttccattttaaagatgaagagactgaggttcagagctgttaagtgaatgctccagcatcacacagttacaaattggtagcacttgggccggaacccaggagtgtctgattccagaacttaagatcgttaactcaccacctgccaaaataggtgcctggcatatatatcaggttctcaagacattcatggagccattctgaggtgttctggagaaaagcaggcccttcctttcaaatcccaccctaaagagggctggttgtctattcagatgctgggtagaggtataatgggacttgaggttaacagaacccaggccacccagatgctaaccccacttttcaatctactgaccctgccatttcccctgcaaccgggaaagacagggagcatcagggctccattttcactaagaaactcagcgcagcccatgtccacattgcccaggatgcgcctggcacaaaacagcctcagcccatgtttgccgcatgaggaatggaaacaagccacagatatgacaggcatctgcagtctaggccacagcttggctcccggctgaaaaaggccaaccatggcgtaaacctcacctgtgtcaggccgctgaggccccgcgcagctccattggcccccagagcgaggtaggttccacagagcccctccgcgggtcggaccactgtgggcagcaggaaagagagtggccgcttccctggctgcactgaattctcctgttgttagaggacagagaccacaaggggcaggtggggtgggacaagaccgggaaagggcccctccacaacccttccaactgctctccctcttctacatcttccacaggcccagttttcctgggagactggtcccttcccagacaacagtttgctatctgtgaaatgggtagggtgcctggatgggtggggtggatgggggagtgataagtacatccactgagctatgaggctgctacgggtcacaggagaaaggaccaagccaagaaagatggcaatggggaagaacaggataaccccaccctgatcatctctatgtgtctttgccctgctggggccccagatggcggggtgtaagagtgctgatttttaactagataaaaattattaaatccttcctccttgggtccctctttggtgcccaaccatagggctgagccccatcagctcaagctcacatagtcacagaccgctagtgctggaaaatgcccaaaacatcaaataggagccaaaaccctcattgtacaggtgaagaaattgcccagagagggcaagatcttcacaaggtcacacagtaagacagtgacagaatgggacaagggttcttcagacccaccaggctccatgtcccagacttagcagggctagggatgaggtgaacctcttctttaggcttccttatactagaagattctggagaaagtagggagaaaggggcagccatgccattgcacctcctacctataggcctcagggtccccaggaaagcagggaagcaaatcctaccaggctgggtgcagagtggttagctgtccggttgggccaggagaagtccagcatctggctgttgagcaggatccccgagggggtgataaggccgctgccaaagggctggttcagggagctgggggccgaggtggggttgggtgagccctggcccatcctcacctctacccagcccccaccccctcttggttcagaggatcccttgttccaggttctgagtctgagctggcatacctaaccatggccacaatgaagtcatcaggtcccatgatcagcacctgggcagccgtgggagctccgtctagttcatagacaggcaggagtggggcaggggctgcctgggagtcattgatatggccccggaggtaggcggcctccaccttgctgaaaagacaaggggtgggagatgagcaaacaacaggctctcaatacaccccacctacctcacttttgtggtgtttgtgtaattatttgatgaaatctacctccctcactggactactaggtctatgagtgcagaagctcattaattgcacataagaaatacccagaaaatagctgttgaatgtatttaggtattatttagattcttttctggaaccaacttttatttaatgtttaaatcaagagccttttagttatctgacttcttaatcctttctatgaaagtgcctggtgcataatggatcagaaaatatttgctttgaattaacaaactggattcatttaaactaatgtttgtagtctaaagttttattaagagtttagttgggggaggattttgtatatgaggattttttttttcttcctaatgagatagagtttttctctgtcacacaggctggagtgcagtgacgctgtctcagctcactgcaacctctgcctcccaggttcaagtgattctcctgcctcagcctcccgattatctgggattacaggcacctgccaccacacctagctaattttttttagtagagacggggtttcaccatgttggccaggccggtcttgaactcctgacctcaaatgatccactcacctcggcctcccaaagtgctgggattacaggcatgagccaccacatccagtcaggatctttactttcttttagagttttttcccaaggcacagagtaagtgctcaataactatttactggatgaactggttgaatagatttcatataggtgtgtgtgtgtgtgtgtgtgtgtgtgtgtgtgtgtgtgtgttttagagcaaagtttgcattgaccttagaaacaatatgtaatgctccagacttttaaaaattcaactgaggcgggaggctgaagcaggagaattgcttgaacctgggaggcagaggttacagtgagccaagatcatgacactgcactccagcctgggcgacagagcgagactccatctcaaaaaaaaaaaaaaaaaattcaactgagggtttcttacctaataactatgtgttggattatccatagctgattagagaataagttaccaaagattacttgaagacatttattcaattttcaaccaaacaaagctttacatgtatgattttgtttagtccttaccacaaccttacaaggttgataccattattgtcaagcccccttgtagaaacagatttagagagtttaaaccacttgcccaaggctgcacagctagcgaagggtcaagctggaatttgaatgaaggcagtctcaccagagcccacaagctactactatgttatgttgctaatgaagctgtattaccaccaccttcagtatttgcttggagactgtttgtttgtttgtttttggagacaaagtctcactctgtcacccaggctggagtgcagtggcatgatctcggctcactgcaacctctgcttcccgggttcaagtgattctcctgcctcagcctcctgactagctgggactacaggcacgcgccaccacgcccggctaatttttgtatttttagtagaggcagggtttcactatgttggtcaggctggtctcaaactcttgacctcaggtgatccacccgccttggcctcccaaagtactgggattacaggcgtgagccaccgtgcctggcttttgtttggtattgagctttcttttcctactcaaaaggaggagcagatgggcttatataggtgctatgctagcctcaaaaaaatttaagagccacatgaagtaagccaactcattgtgctgataggaaaggtgaggtgcagggagaggcacccagtgtcacgttgtgagttggggttgagctgaaattgacttaggatttcaggcctttattgctataccagctgcttttctcctgaccctttccccacacccaccgctgcctctgtagcccccaggtcctgcccaagacccacctgagcatgtcatccatgctctcagtgatggtagaatcatagacgggatctcccagtctgctggccagggctaatgcaatcttcagggtctgaaaatacagcagggatatggaagaggctgccaggcccctcccagaacccacacccagtggactttcgtgtgtgagaaaacttggaggggatttagtcctgccctatggcagtacccaatctccccactcctaatatccttaaatccagggaaaggcagacgggtcagccttacctctgccacccagtgaagagcctgttctcgggataccaggctggtgagattgaagccctccaggatgttgagagcactgatgagggcagggcccgtgtgcggaggtgggggactaagaaccaggtggcctgaaaggacaggaagtgactgatggcagggtaggggtcaaggcaccttcacatcccacatcccatctccacattccaccatcacacactgagaccactgcgctgaactccctcaccagatggggaaactgaaacattgagaggcaaagagactcattcaagttcacatggcaagtcaagggcagggccaggacttgaactcagaacactggtcttcagtttcctctgccatttgagaaaactaaggctcaagagggctgtggcttgcccagagtcacactgcaggctatcagcagagcacagcagaaacaggtgaccagatgttcatattcctggcctgtcatgtgtctccttttagctctcccataggccaggatattatccatgactcctgatggtctcatccagccccaaacttcttggcagcagcaaccttctcttcctattctgttactagatgtttggacatcaaaggaataatagctgatgcataacactaacattaactcatttagtcctcactgtggctactgttatcacacatatttgataggtccagaaactgtggtacagagagacaaggggaatccagagcactcaaggtactagcattgttgagacaacccaggctgggaaggggaaatggaaaatctatattcagtgcatgctctgatcagggcaacttcctacatcatctcatcaaatccttatgggcatcctaagatgtaggcactattattatttccattttaaggagggaaccaaggctcagagtgggaagtagcttgttcaaggtaaatggcacagttggtactcaaacccaggtcttcctagctccaacgctacgcttgttcttttttcttttctgtgtgtgtgtgtgtgtgtgtgtgtgataatggtctcactctgtcacccaggctgtagtgcagtggcacaatcatgcttactgcagccttgacctcccaggctcaagcaatcctcccatctcaacctcctgagtagctaggactataggtacaccaccacgcctgggtaatttttaaattttttatagagacggtgtctcactatgttgcccaggctggtcatgaactcctgggctcaagtgatcctcctgcctcagcctcccaatgtgctggggttataggcctgagccactgcacccagctgataggctctttccattgcttcatattccactgcctctggcagaggaatcaggttggagattgaggcctggaaagttgaactcagagaaaccctttcctggggcttgatgtgatctggctctcctagaagggaaagaacctgagaatcttctgagaaatccagcacctaccaccttgggttcagtaaacatggaccccacccatgtcataagcttggttttctgggttccctgttggttttcttgagtttggccagttgttatattccctcctcgggcctcaatttctttttggcactatgaggagctgggtctatgactgtcttgaaaggttcattctactgtgaagcttggatggactttgtcttaaaaattcttaggaagtacagggcagtgacagcgctgctggggaaagggcagaggcaacacagagcccaaatcaagaaaacctatggccagaaccccaacttccaggttggaccctttgaccaggtccaccccccaatatcctaaatacttggggtaactgaccccacagctacttttcagaaggtgggctgactctggtttgcttcaacagttgactgcccaggtagctcactgccttagtttctctcctgtgaaatggagaggagtctctaggccaaaacgatgtggccatggactgggaggcttctcctgaggggggaccctgggagccgggggagaggtcacctctgtacacgccacacacaggcttctccacaagggcgctgtaattgctgaagtcctcttcggttatgacaccccctgcgtgctgagcctggagggaagagaatgagggaatgacctcccaccactgtgacatggtggttttggcctataacacgtttggatcacagacagatcagctgtttataacttctgtgccttctgcaacccccatcgtggcctttagagaccccattatccctagacacctcaggaaaaaggaagggggaaaagcactaacattgagcacctatcatgtgccaggcatcacactgggtacattccatgaatgacctccttagcttgccattcaagactttttgtgatctggccccagcctacccctcccacctcatgtcctgctgttccccagtgagctctatgcagctgcagagtgacctgcagttcctgaactcatgccttcgtgtctttgtacctgctgctctctctgcctatgtaaaaggaaggttttctacttatggcacacttgcctaggagataccaaaactgaatgctgcatctcaccacaaccaactaaagccactagaaaaccatgactttgagtgatcctagaaggactgacccttattggacataaccaagccctcattattgaccaatgaaccaatcttgtacaaaccaatgggctcattccatcctatccagtgtgctgtcaaccctaaattagcataaccactctgaatcctttccttttttgtaccttatagtacttgaaacccttgagttatctatcttcagagaattacacattgattttttttttttttttttttgaggcagggtctcattctgtcgcccaggctggaatgcagtggcacgatcatggctcactgtagcctcaaccttcccaggctcagatgatcctcctgcctcagcctcctgagtagctgggactacaggcacatgccaccacacctggctaatgtttgtatgttttgtagagatggggtctcactatgttgcccaggctggtctcaaactcctgagctcaagtgatccacccatcttggcctcccaaagtggggattacaggcatgagccaccatggcctggcccatttgaattcttgagttcctttttctggcaagttaataaactcaactttgggtttctttttatcaaagatctgatggtctttgttacaatctcctgcattccctttgccacctccaggaaagggcacacaacccaggcctggccaattggggcattcccttctgtgccacagtgattgatttgggaatagtcatgaaacctatgatgagctaataagacacaacctggaggcttttgctggaactactgggaaggaaaaatgctctttctctgggatagcttgctggaaggatggcctgatatgggctggtggggagcaggtggaaaggatctgagagtgaatccaaacaaaggaaagtagagttgagagagagagaaagagaaagagggagagcaaatcctaacacagtggattgataatctggacacagaagaatctaaagccagtaatctcctggactttccagttaagtctgtttgagtctatcgccacatccagtgcccagcatagggcttggcacagagcaggcactctgtgaatgttgaatgaataacagacctatttaattcccacaactgtatggcagagacagatataatcatccccattgctcagatgagagaaccactgagttggtctatgcatccttaccatgaacttaattttccattaggacttttgcactattaatgacagttctcacatctgttactgcctgagactgggactctttgggattggatggtaaacttctgtgtcaatctccccagtcttgatactcaacaatgaaagaggtgcttccctcagtccctagaaaacccaaaagcagggaaggattgtgagcttagggaagctgaggccgatactgggtctccaccaggcctgggagggacatgacaagcccctgcacaggctggcatcacccctgagaagcccaaaggtacctctgaatcaagacagaacacttctggctaggcatgggggctcacacctgtaatcccagcactttgggaggccaggacaggtggatctcttgaggtcaggagttcgagaccagcctggccaacatggtgaaacctcatctctactaaaaatacaaaattagctgggtgtggtggtgcacacctgtaatcccagttactcgggaggctgaggcaggagactcacttgaacctgggaggcggaggttgcagtgagccaagatcgcaccactgcactccagccagggtgacacagcaggactccgtctcataaaaaaaaaaaaaagacaacacttccatcatcccaggaggtttttcatgtcatatcccagtcagctcctcccagccccaccaaccactgatctgatttctgtcactagaggttagttttgactattctagaatttcaaatgaacataatccacagtaaataatatagaaagaaagggagggagggagggaaggaaggaaaaaatgcggacgcggatgtcctgcaatagggaccttggggcatgcccccacccgcacaacacgagcacttacctcggccaccatctccagtgtgaggttgccacctgcgtagaaggcagccgggccggaggtgccaagtacatccagcacctcagccaggtcgggccgatgcagcaacgagccaggtagtggcgggcggcccgatggcaggaacgtctcccggaagcgctcggacatgttgggtggcagctgttcagccagggcacgggctaggggcagggacgggaggctgggcagggcgggacgccaggactggaccggatgagacgcgcaatagatggggtagatgggggctgagtggcccaccctaagtgccctgacccccaggagcctgttaagtgcgaggcagggatgtctaagggcccttcccagaccccctcgtttgaggccgcctccaggtgagggtgggataaggtggggagggggtctgaggagcaaactggaagagagggcctctctggcttgggctccaaatctcaaagattctacccttctccatcaacctcatgtctctcccaaatccccaggccccactgacctagatcatgagtcacgttgaagccatcttgggccacagctgctgcaaaggccaggacttgggaccatggcagcctgggggggccggagagcagggggtggaggaggtcctgggggaatgaggaggggtccggggggaggggggttcctgggaaggagagtcctggcaagggaaggggatattaggagggggagttgggaaaggaagaatccagggaagtaggagaaggccacccaaggagagatgcaaacgggggtccctggtccccagggggagggttgttacctgccatagagctggtgagcttcatgtagccccttcaccattccgggaacccccaccaagagcccaggctgggcaaggcgggtaggcgagggagagaggagaccaggtcactggaaggggggtgctgggctgaactccgcagagccccaagccagggatggctggcacaggggagagacacaggccaagtatcccaggggagggacaagctttcccaagcaggcacccctcccatctccctgacttcctatcagcaaatgcagaaaggcctcttttagctgccgtagttgggggatttataaattaagcaaaactcttttaagagccaggacataaccagtgtagaaagacacctgtctacattggatttcaccaacccctgcctttttttttttttttttttttttttcctgttacccaggctggagtacagtggcatagtcatagctcactgtggcctccaactcctgggctcaagtcaagcgatccttggtgcatgctactgtgcctggctaatttcaaagcattttttgtagagacaaagtctcactatgtcactcaggctggtctcaaactcctggcctcaagcaatcctcctgccttggcttcccagagtgttgggattacaggtgtgagccactgtgcccaggcaaccctaccttttaaaacggtggacaaaggaccttcatttaacctattcagtttcaccccaccattactctgagctctgaagactcaggggtgtgtttggcttttgccaccgcactaagtacccatttttccaagttattcgatatcttctttttctttcagcagacagttggtttacttctggcaattcccctctaatcttccaatatatcaagggctgggaaagttatagtcaactggctcagagtgagatgtgtgagtttcattgcatcaacttcgtgacatttcagggtactcagtagccttttttcttccttcccacgtgccagataggtaagattcccagagaagtaaggttccagattttctagttcattattttatcttgggggctgcctgactctctcatagcctaagagaatcctgctcaactctttttcccactcccctggtaaatacttagcaaattaatgcttgggttagcagaagggcaatgaagagagactcccctgaactctctcttctcaccagggtccccaccttggtctcccaggatctttgcagggtctcttccctgagggcccctggtgcggactcccggaaatcaattaggtggctctcatttcgtcggatgtcatgtaccagcatcacgcccccactgggagagacacagaaggggaagtgtgatgataacatgctacccctctgtacaatgaatctgctgcccctccacccccagtggtgagagctgtaggctcagtttttcatttggggtcaggtgtctgagctccctccccagcatggattcacagactcagccaccctaagaggatgggagcaaaaccaagagggttggagacccagggtccatggacctcttctatcctgtcactggagactttaatccctgattaggaaaagcccagagactggcagaacaggatgttctgccccatgcccccaccctggaccagagctggacccctgccagcttcctgcacctgtctacttggtatgtcccttgcccctcccccaggactggattatgtaaggatagaacatgcaaaaccaaaagaggaatttctttggtacggcttggagagctggtcttacaggagccaagataggaactttgtcagcttgttccttttctgtagcttatttacgtctaagatgggggctgcaaacttaaatgcccacagccaaatgacaaactaaggcaagcaggacagagaagaggaagtggtagaaactacggcaaactggacagtgcatgcccatcatgggaagcagcttctattccacgccaggtaacttcagccatgtgagaatgcgggcccaagttgttatcggatttcccgattgttcaagagatgttggaaatctggatttttatgaaaattctcaactttttaacaaaagcaaacaaaattttaagacagttcagtgtctaaaccaaaccagtctgtgtgctgggtgttgcccatgggtggccagcttgtaacttctaagagttcttagtgcagggtgtatttttggaggacagagggtgcaaggcttttcatcagacccatagggatttatgatcctagaagttgaaatatctctgccttaattgatgacagtatacctccacctgtgcatcttaatttatggtttacaaatttctttttctagttaaaaaaaaaaaaaaaaagcttctgaaaacactttcaggttttccataaggtagctttgctcttctgactccatccagggagaagggggtgaaatttggtgtagaaagagaaaatgcaaggagttggggcccaaaagcccctctccctaagttaggagtgctgcacatgaggcctacagacctggaggcaagaagtaggcctgggggaccccgacctccactgctccttacccgcccaggccagaactgtgtggagccacgatacccaaacacaaggctgctgccaccgctgcgtccacagaagatccctgtttactgagcacctcgatgcccagtgaagtgcagcgggcagcatcggtcaccacggcaccctgctggaagatctgggaggggaaagaggacttggtgggggcaggaggagctgtccacctccctagggcacctccactagccctagaactctacgcggcatgaaggtcgaagccctgcccccttgttgccttgactctgccctcattaccccaagtgcctcctaatggatctgtccttattcttccttgttctgtctccctcatgccctggagctcctctctttgggaccttcctctcccaagtcaccaccctctctccccttctaccactcagccattccccagtttccacagttcctcaaacattaccccactccccactccccagtttcctccccctccccatttgtccccctcacctgggggtccccgaagtagatctgcatgaccagcgccacggtgacaccggtagcgaaggtgagacaggccgtgacgatgaccgtgagcccatcctggcggcaggagcactcggccgctgcggcggagaacgggtctttgcgcgtctcgcgtagcggcgacccgtcttggctgcccatctccgacgacgacgatggcagccgctgcagccgtgcagacttcaggaaggagtccgggtctgcgggcaggcagccggggtcggtctgggcatctcctatctggccctgcccaccctccaggtgggactattcagcgctttccctgccccgcccctgccacacaatccccgcactggctagcactactcacctttcctcattttcgcgtgcaccccaggacaggcggggcaacggtgcccggctaggaagagacagggacctccccagctgggcagcagggaggctggattcccgcccctccctgatacctaggccaaatttcctggcacccagggcccagggctgagaacacttcctggggggtggggtgggggttccagccctcagtggaaatcggatcctgccccagttggggcccagccttccatgcaaggaggcagctacataaacagagtggagggaccctgccttccaacctcacttcagttatcagctcactcattccttaaatatggagagccctatgctaggtgccaggggacgggaacagatagttcctgccctcatgtggttcatagagccctggaagaaaaagccaataagcaaaggagtctataattacaagttgtggcaggtgctatgaagaaaaaggaggaaatgacagaataatggtggtaggggagggaggattccttagctgcagaaatcagggaaggcctctcaggaagtgacttttaagctgaaaactaagggatgagaaggagccagctataatgtagagcaaagagtatgtgtgtggaatgttctggaaagagggaacagtggatgcaaaggccctaaagtgggaatgagcttggcacattagaaaaaaaaataaccaaggcctgggcggctctggtgtagcaggcatggggaaagagtagtaagggtggaagctaggccagatacatactgagcgcagtggctcaatcttgtaatcccagcactctggggggccgaggcgggtggatcacttgaggtcaggagtttgagaccagcctggccaacatggtgaaaccccggctccactaaaaatacaaaaattagctgggcatggtgatgtgtgcctctaattccagctacttgggaggctgaggcatgacagtcacttgaacccacaaggtggaggttgcagtgagccgagatcgcgccacagcactccagcctgggtgacagagtgagactctgtctcaaaagaaaaaaaaaaaaaaaggaagatatgtggggctctactagcctggggagaagcttgggttttaccctaaggactatgggaggtcactactcgagaggctatttttgtttgtttttgagatggagtttcgctcttgttgcccaggctggagtgcaatggcacaatcctggctcactgcaccctccgcttcctgggttcaagcgactctcttgcctcagcctctccagtagctgtgattacaggcacatgccaccatgcctgagtaattttgtatttttagtagaaacagggtttcagcatattggccaggctggtctcgaactcctgaccccaggtgatctacctgcctcagcctcccaaagtgctgggattacaggtgtgagccaccgcacccagcccactactagagagttttaagcaagaatgtgaaaccatctgttctgtgtgttattgttgttgtttgagacagggtctggctctgtcaccccagctggagtgcagtggcaccatctcagctcactgaaacctctgcctccctgcaacctctgcctcccaggctcaagccatcctcccacctcagctcagcttcctgagtagttgagactacaggcatgccccactacacctggctaatttttgtattttttgtagagatgggatttcgccatgttgcccaggctggtctcaaactcctgacctcaagtgatccactcacctcagcctcccaaagcgctgggattacaggcatgagccactgcgcccggcctgttttgtgttttaaaatgatccctctggctactgtctggagacaaactggaggacgataagagtggaggtaggagagaactgaaagctcactatttgctggtggctatggacaagtcagtcaagtcatgcacctcaccttcctcattctagtaatggaactaatccctaactggtgggataggggtacaaggattccatgaggtgatgtgcacccagtgcactgtaggtactcactccaagttatttctattccttttccaccttgaccagggctgagaccctcttccatcccatagctccctcctctgagtgttattagctgtgaacccaggtccctaaatggcctaaaggtcctaggtgtttgtgaacagtaaagaaatagtctttactttaccttgacctcatgctgtactcacaatatgttttttaaagtttattcattcaatttttttagtacctgctactatgcactaggactataacccctttaaaagtctatgtgataatattaaaaactgaccattttattgttctgtttaaaatacgtggttcactgatgccaacataataaacatctaagctccttgtggtgtttaaagaccttcatgatccacagtcccatcttttgtgtaaataagaaaccaaatatatagataaaatgatgatatatgcaagaaatgtttataaattattacagaagttactcttgggaaaggatactgaagatgggaatgagatggggtgggagtttttttggtttgaaatttttaccacttatatctatttcctttttagaaatcaatacataaaccgggagtgctcgtgcatgcctgtaagcccagctattcagaaggctgaggcaggagatcacttgagtctagaagttcaaagctgcagtatgattgcaatatgaatagccactgcactccaggctgggcaacatagatagaccctgtctctaaaaaaaattaacacatatattttgaaatgaaaaggaaaaattacagggagataggaatgggaaaggggacttttttattcttcctcactattgctttttttttttttatcatgaacatgtaatttttgtttttgtttttgtttttgagacagagtctcactctgtcgcccaggctggagtgcagtggcgcaatctcggctcactgcaacctccatctcccaggttcaagtgattctcctgcctcagtctcctgagtagctgggattacaggcacatgccaccacgcctagctaattttttatatttttagtagaggcagggtctcaccatgttggccagtctggtcttgaactcctgacctcaggtgatctgcctgcctcagcctcccaaagtgttgggattacaggcataagccaccgcaccctgctgtttttaaactttattttcaaaaaaaggttatcttctgagactctccctcacttcataatgcttgcctctaaccctcaacatcagcatcacagagtctgtaaataaaactggaattcatccaaacaaacagacgttaaacacccactgtaggcacagaactctccttggcccctagaaatgtcttgttgttgttgttgttgttgttgctgttgctgttgttgttaatagagacaaggtcttgctatgttccccaggctgttctcaaactcctgagctcaaacaatcatcccgcctcagcctcccaaagtgttgggattacaggcgtgagccacagcacccggcattagaagtttcaaaagaagtgtgggaaagggttttgaacttatatttattgatgctgactacatattaagcattttacatatattcctttattgaagtgttcccaagactttatgaaataagtcccactctcgccactttacagatgagaaaactaagaccaagaaaggtgatattgcccatctcaggtcataaaatgagtaagtgggccaggtttggtggctcacgtctgtaatctcagcactttgggaggccgaggtgggaggattgtttgagcccaggtattcaagaccagcctgggcaacatagcaagactcctgtctctacaaaaaaatttttttaattagccaggaatggtggtgtgcacctgttgtcccaactactcgaaaggctgaggtaagagcatcacttcagcctggtagttcgaggctgcagtgagccactgcccaccagcctgggcgacagggtgaaaccctatctcaaaaaatttaaagtaaaatataaaataaaataaaatgaataagtggcaggaccaagagtctgtgtaactagaaagcctccttcccattgctccacatggcatcaagagccatttctaccctcagaaaccaaccttacaagctaatttttgttgctatttcttggtacttattgctttgtttttgagagataatcttcctgccaggctggaatgcagtggcgcaatctcggctcactgcaacctccgcctttgggttcaagcatttctcatgcctcagcctcccaagaagctggaattataggcatgcaccaccatgcccagctaatttttgtatttttagtagagatggggcttcaccatgttggccatgaggctggtctcaaactcctggcctcaagcaatccgcccgccttggcctcccaaagtgttggcattacaggcgtgagccactgtgcccggccctaggtatggtttaatttgttttctccagtcagatataaggatccaggaggtaaaggtgacatgtccctatcatagctattcaagactctctactccaccagtccatcataaagttattgatttatacaataaaaatatttactgagtacctactatgtgcactgtggaacagctagggcaataacagtgttgattttactgatagggaagagcaacagcaggatactggaaaaagattaatttgcaaccagaaggaataagtcttttgggagaaagatgacaagttcaattttggttattataaatttgtgggacaccataagaagctgtctggaggcagttggcctagtagatatctaatttttaccttcagggctcatccctggtatctgcttggataccacttctcattcaattttcttttaaggaacattctctctcctctctcagccaactccctcatccctgaccaaagtatataactcagacttggccagtcagaacaggtacctctgtgcagtaacaggcaatgtgaacaaagccaggccaataagacccaaactttgttattttgctggaactactgggaaagagaaaggctcctctttctattacacttaagttgctaagttggtaggatgtaagcctgtagctgctgggggcatcttgcccctaataaaatgggaggccttctgccaatgaagcccaccaaaagaaggcagagcaaaagatggagaaaagtccattcctttttaggtaccttaatccagctatgcctgaaaccccatatccctggacttttcagttatgctacccagtaaaattctctttttggatgtagctcagttaaactgggtttataacaaaataatcctgaacaaaattgattatacaagtccagagtttaggagagtgatcttggctagaggctagggtcatccctggcttgttgtttattcccttaaggggagaatcactaaaataaataaataaataaatatatatatatataaaattttgaaacagtgtctcactctgttgcccaggctggagtacagtggtataatctcagctcactgcagcctcaaccttcagggctcaagccatctgcccacctcagcctcccgagtagctgggactacagacaggcatgcaccaccacacctggctaatttttgtattttttctagagacagggtttcaccatgttgccccggctggttctgaattcctgagctcaagcaatctgcccaccttagcctcccaaaatgctgggattacaggtgtatgccactatgcccggcagaatcaccaaagatgtctgaaccagggagtgacatgaccagaagcgatggatggattggggtggggactgggcaagagggaggaggcaggaggagtagctagaagcctataaataatattgataagagaggttggtggcttagtctacagtggtgatgacagggatgatgagtaggaatttggaagatacttaggaggggtgcagagagcacttgatcaccatttggaaatgagaagaaaaggaggagtccagcatgccattcattattgggagactgggtgactggcagtgtcattaatggagaatggcagtggaggaagagcaggtgcatggggaagggatatgatgagttcaaaatagaacatgctatagatgaggcacttgcaggacatctggagacacaggcctgggagagaaaggaacacaagggcttggagctcagaagaaagaaagtatttcccaaccttggaatgatcactgtctagctctctttcccacagagcctgatgtggggtgcctggcacttgggtttagggaatggcaggctagaggctagctgggcacaaccaaggtcctggctaagaggatggtgctgtgccactagatggtaccaccaggttgagaacacaggaggccatgtcagcctgtagtctggtccaggtgaaccgaggaagccttggggcttggaagtaggattgggagatatggcattcaaatgattacactgaaatgatggcaacacacaaacctgacacataaatttggcataaggtataaactcccagaagctcagatgactaggatctctgctggatttccatacaggggtgagggcagagcctgtattgaacttcccaaaatactccctgaggttttggaacttgctctctcctaccattctttcatcctctctcctaccattctttcatcctgagatcttctctctcatgcatttattcattcaacaattattgagtgcccaataaataaatagagatgagggttttttttgttgttgttgtttgtttgtttttttgagacagagtctcactctgttgcccaggctggagtgcaatggcgcgatcttcgctcactgcaacctctgcctcagcctcctgagtagctggggttacagacacctgccaccaggcctggctaattttttttttttgtatttttagtagagatggggttttgtcatgttggccaggctgtttttgaactcctgacctcaggtgatccacccgcctcagcatcccaaagtgctgggattacaggtgtgagccaccacaccggccagtgtattttgttttgttttttgttttttgtttctttttgagactgagtctcactctgtcacccaggctggagtgcagtggagtgatctcggctcactgtaacctctgcctccccagttcgagtgattctcctgcctcagcctcccgagtagctaggattacaggcacccaccaccatgcccagctaatttttgtatttttagtagagatggggtttcaccatgttggccaggcaggtcttgaactcctgacctcaagtgatccacccacctcaggcatgagccaccgcgcccggcctatggataaggtcttgatgctggagaaaggagagtgaacaaaacaatcatgatccctgccctcatggggcttacagacagggagtaatcagataattgcacaaataaataatcatagattttggtaaatgctaagacatttacagagggccagaagaaaacatgtcaggcagttccaatctctaggtcaagagagacaggcattctctgttgagctggaagaggaaactaaggcccaggacagggtaggtgtgcctgttgtcgcttggtgagtcagggctgtattaggaccagaagtctcactcctgactactgaataaaaggcctagcttcaggctgatatccatcatgacacatcttcccactcctctccctgctacctcctgattccactccctttggaaaataagttttgatccgcagccctgacatttgacgcccataaacctctaaactccatcttcattatctcctcacccccaccccatacagagtgcagtccagtcaggttggcaagggctgctggtcagggccagatgaccagaaagtgtagaggaggagagaatttggggctttcaggctgggagcagctagggaagggccaagccggaaaagcagcatctgccaggctggtaagagacaaggctcaagtgcaggcactgcgaggaagcgagagtgaggtagaaggatgctctaatgccaggaagtgacgtgcagggacagagggatgggggatgaaggatgaagaatggaggggaggatgaagctgggccacatggctaggaggaagagcagcagggaaggaatgcacagagagctctttgcccccaggtctcttccaatccctgtctcctccttctcttacccccacttctcacaattccagcagagggctgaggggaacacagtaaaattctggagactgcttcctagggagcagagtaccttactaataccccggccagatccatggctcagggaggggtggggtaatccacaggagagtgaaggcgttctagtccccaaggacttttgagaggtcatgcagtccatgcctccgtctcccaacacccaacagaggggaatcatattctctttacccctccctagacatgaagagattctccgcttctcccagaccctctgcttctcacaatccctggctgtggggaacttctcttaaggcacagattggatccctcttgctgcagtctctgacttggtttctcctatcctgtcctctgtggctagagaaagccctcttctgggtgatcacagcggttccttaggatctccccttcaacattccttcatcgttagttggttcttcccagaaggtaagcccaatcccttctactgcagtccctagcatcctctccgttgtcgcatcctacgcctccaaggcagaaatgcacccccttcctcaccaaataattaacagagacaagggagaagaagggagagatccaagaagatggggatgaattaaggagatggagctggaggtggatgcttgacacagaagaaggaagaccggggacttcccaaggcagggcagggacggggtcagcgggcctcaccggtgtcggggtctcccagaaaggcgtcctcgtccttgcggcccctcagcggggccgcgggcgccggctcgtcctcgggcagccgcgggaagctggtgatgctcatgtagtccactggcgagtaggcgcccagggcgctctcctggctggcctcgttctccgccgccatcctcgcccgcgccccccagcagcgcagcgcctgccggaagtggctgcggcgggggagtgggagggcggagggcggggcctgatcttcgcgacagccgggagggggcgcctctcccagccctcggccgtgtcccggtctgactcgcccccgtctgctcagcgctatcagcctgcagctggcacacaggtgcgtgtagatggacagccaggaaggcagcgcagggtcgaggggagagcgcggggcaagcgagacttcagtggctctgcactttacgcagctcagggaccaaaccccttcctccttccagcctgaatacagctagtgtcctcctcaaatcccaggcttccttttcgggccccagaccctttcactgaccgcaaatccctctcgaccccagatcctgtctctgaccccaaactcctcggaccccagacccctccttgaattccgagatcctcctcctccgattttagactcctcctccgaccttagacctctttttcgacttcagactctgtcttcacccccaaacccttttgaaaaccccagcccatgcttcatctccaggcctctttgactgcagacgcctctttggacaacagatccctcctctgacctcagatcccttcccgcaccccgacacttctgactcctctttcaaccgcattctcaaactttagtgtgtgttaggatctttgaaagcggatccccagattccactccagagatcatgattcagtaggctgggatgaggtccttggaacctgaatatttaccatcattttaagagtttttgatgtggttctggaaaggacactttgagaaagaaggagtggtggtagtgatggtagggcaggagtggggcaaggtggggaataggtctccatattctggatgtctgggttctattctgccaccgctcaaacactgtgtaatcttgggcaagacaattagtctctctatcagtttccccatctgtgaaatggaaagaataatagtacccattttagagggttgtcatgaggattaagtaacagaatggaaagcgattagtatagggcttggcacctactcaataaatggcatcatcatcatcatcatcattgccttaatctggtagattcattccctccaaactcatccatcctctctccactccaaaattccaaccacactacagcttgtactacttctccatatccaaggatgagggaggttccttcttttacgaggtctctgttccaaactttcattgtgaagtccacaggaagagaggggggctggtgaagcctctatacacacatcctttctcttcccaaccccagaccagtctcagggatggcctgaagtgcttgaaaaatctactatatacacagcagctgcagtagcaactatagacaggagggggaagcagtgtgtcgggaacagctctggggtttgggtgtaggacttgggagagaggataggaaggagagggctactcagagctgtgtggtaagagtgcccagggagggtaacagtctatcaccaaaaagtgtacccattgtctgtgcctttccccaccccagagagttcttatctcctcagtgatgtttgtagggtctattacactaccctgaggtctaatccctctggtgggacccttccccacttgatgaggtctgcaccttctcagtgatgtccactcccacagtgtagttggcagctcctcactggagtttgagtcctctggtagggtccacgtctccttagtaaagtctatatcctctgtatctcttaggggaaatccatgtctcctcactagggtaagtgcccttcaaagccattcatgtcctattagcagggcccagggcccttcagtcagatctgagaacccccagcaacatctgtgctcccttagtggagtccatgtactgtcagtgaagtgtgtgtcccttcggtgcagtgaatatctcctttatgaaagtatctgaccccttggtggggtctatgtccaccccaagaggtctgtactccttcagtgggccctcagattcccgccctccttgggattgggcagactctcggtctcccatagagagattttttttcagcttagggtgtgcaaggtttacagtcagctgggcaaagtgcagggaagtagctgggaagggaggctgggctagatggggtcacaaggcctgtgtaggcttcaggaggtgggagctgcccgcttcaggcctcagaatcactcttggagttagatatttaagaatccttcctgccttgacagccagtctgtgaaatgatggtgaggtgggcacttctttgtggtgagtgcaggtgagagatggaggagggtcctgcctgacttctttctggggtggaggggctagagagaagctagaggtaattaagcccaggttgtggtggtggtggtgggggtttcccttggtggagtaaagagattgtgaaggaaagaagagaatgtgggccaggtgtggtggctcacgcctgtaatcctagcactttgggagcccaaggcgggcagatcacctgaggtcaggagttcaagaccagcctggacaacatggtgaaatcccatctctactaaaaatacaaaaattagctgggtgtggtggtgtgcacctgtaattccagctactcgggaggctgaggcaggagaattgcttgaatccaggaggcagaggttgcagtcagccgagattgtgccattgcactccagcctgggcgacagagcgagagactccatctcaaaacaaaaacaacaacaaaaaaagagaatgtgaatgatttttcctatttgcacagactttgatattttacaagccttagcttcaagcctgacgaggaagtaaaaccaaatctggagtcaaagaacctagctttggccctaacttggtcgttatttgctctctgactgtgcaccagttccttccctttcctgggtttgccatttgtgcaattaggaggtgggcttattacaaaaaacctgaaggtgtctcctagtcttcacttattgagtcttgtactttagatctggatggagatttgtgaaggcaaggagattgaagacatgtcctcataagagggagaaaatctgagctggttccagggtgagcagagaggaggtgctgtcgccagagcatgccctcaaggtcatgggagaagtttttccggaggacgagaatgtgggtgtggctcagagaggggggacctggagggaagggtgtcacctggaaggaactggtgatagtcaggactgtgcaatcagatcacggggcggctccgcgatggaccttactcaactcctctccttagtccatccctttccctttcgatccttgccttaacccaaccccttatctgtcactccaagaccccaccccactctggtcactccatggctctgcctcctctcctgtcacaaccagccgggttactccccatcactccatgggcccacctcctctcctgtcccgcctggccccgcccctcccttggcactccacggttccaccctctcccttgtcacacccggccccgccccttctgctttcactcgacggcgtcactccttccggcaagtcagctccacccctatccctcgacttttccttatagtatttctgtccttgccaacctcgatccctccccaaccagacacggccccgccccctctggcaccgcccacccgccagactaagccactcccccactcaccaggccccgcccctctacggaggccccgcctctagttcggcctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcggggtgaggcccggcccgggcgggcctggggtgtcagtgaggagaagagtgggggctccctgggggagtcgggggctcccttgggaagctgaggggtgggtgaggagatggaggttctgtgaaggaagaattgcggttctttgaaaatggaaaagggattccgggaggagacgagggttccatgggagctggggagttccctgcagacttggagggtccgtggtggagatgcgggtttttgcgaggagacgcgggattccgtgagggaagaagtgaggttccttgagattgggacggggaggtcggccaagagagtgaaagtttcatgggaagagaaggggagttcctgaggcgaaaagagggtctctaaggggcgacgggagccttgaagggaggagggccacgaatagaactttctttgcttccctttcacaccagctcagccactgcctcctgagacccttaacctgtgaactgttgagggcaataacgggtctggttcccatcttggggtcctcagattagtaatggagtccccgatctatttttagtatatcggacatcctaatggaaattacgcggtataagactgaacgagttactacgatgtcaagttgttttatttatttttttaacttgggctgggattgtattagtaatagttcagaagttctgatagatggttccatgtctgttaaaatgtatgaggaaaatcggccaggagcagtggctcacgcctgtaatcccagcactttgggaggccgaggcgggcggatcacttgaggtcaggagttcgagaccagcctggccaacatggtgaaacccccgtctccactaaaaatacaaaaattagccgggtgtggtggcgggcacctgtaatcccagctactcgagaggctgagacaggagaattgcttgaacccaggaggcagaggttgcagtgagccacgatagcaccactgcactccagcctgggcgacagagcaagactttgtctcaaaaaaaaaaaaaaaaaaaaaaaaaaaaaaaggtataaggaaaatccccctacccttgccctcagtctgggtaaaggacagatagatagacagatagatagatagatagatagatagatagatagtttgttttgagacaaggtgttgctctgtcacccatgctggagtgcagtggcccgttctaggctcactatagcctgcatctcctgggctcatgcgatctttccgcttcagcctcctgggtagctgggactacaggcggacgccatgacacccagctacttttttgtattttttggagagacgaggttttgccatgttgcccaggctggtcttgaactcctggcctcaggctttcctccttacttggcctcccaaagtgctgtgattacatgtgcatgagctactgcgcctagccaaggagtcaaaattgcacccccattgggaggcagcatgatgtttggttgtgggacaaacatgggccacgaatcaaatccagaaaaatctagatttagaccctggctctgctgttcatttactgtggggtcttaggcaaatttttaagcctgtctgagattccttttcttccatctataagataggtctagtaatacttgcctaatgggtttgtatgaggtctaaagtgtgtaataagtatgcgctataacatgcctgatgcacagtacacattcaataaatagtagttagtctgatacaatataaatcaagcaattaccaagtaatgcaagacaggattcaatcaagtgtaaagtggtggagttgggatttgaaccaagacagtttgactgcagaatccatatcctaatagcaatgctattcctcttccatgaccccacagaatgcatttcaccaaattccatcaaatacagaatttctaccagggaagcagcctcctaatttgtcctctcttgcctagtttcgccaacttgagtctttccagtagatttatcaagacaccattagattgatattatggaaatatgctttcatatgtcactgcaaaaactttcaatggttccctgtttctggcagtttctaattaaaattctgcttttcttttttttttttttttcttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacgggctttcaccgtgttagccaggatggtctcgatctcctgacctcgtgatccgcccgcctcggcctcccaaagtgctgggattacaggcgtgagccaccgcgcccggcctctgcttttcttttaagacctccagataatctagctccaccctgcctctctattcttatctcccactacttgctaccactcccctcattctagatagatcattctccttgatatcctggatacacatttattcccaccttcttgcctttgttcatttccttctgcttctctctacctagtcaaactccaccacttccaatagagcattcactgatcatcccaatttatgctcacctttttcctcttctgaatatctttagtacttagaaactatgccactcatccagattctgacacacacacacacacacacacacacacacacccctaccccccccaaaaaaacccagaaaaactaagtgtgcataaaattcagttttgtagccaaacatggtgacgcacgtctgtaatcctgctactcaggaggctaaggcacgagaattgcttgaacccgggagacggagattgcagtgagccaagattgtgccactgcactccagcctgggcgacacagcgataccctgtctcaaaacaaaaacaaaaacacctcagctttcttcattctttgttgatggacataaatgtggtttataaatagttttatatactatatgcctactattatcacttgaaaatatttttgagtatttgtactctcgttattagctgcgtggtccttggcagagtttcctgtgcttcctgagcttcagttttctcatctataaaattaggataattaatgtatactttgtaagaccataatgtcataaagattaaatgagattagtccagtccctgatacatgaatggcatttactaaatactagctctcatttgctttctctttaatggccatttattattctatggtattactacttgtattactagttttcatcagtttgttattgttgggctattgggttgtttccagtttcactattatagtgttgctataaacatctctttactaatcactttttttctttgtgattattttcttgaagtctattccctatagttgagatagcagagaaaagggtataaaaagttttatgggctgggcgtggtggcccacacctataatcccagcatcctttgggagggcaaggtgggctcccaaagcttgagcttaggagtttaagaacagcctgggtaatatggccaaaccctgtttctacaaaacaaacaaacaatgtgcgcctgtagttccagctactggtgggggagggggtacagctgagatggggggatcacttgagccagggagatggaggttacagtgagctgagatcatgctactgcactccagcctgggtgacaaagagcgagacaccgagctaaaaaaataataataatagaaattaaaaaaaaaaagttttatggctcttgtcatgcattgccttgcaatctaataagactgcgccaatttcttacaatgccattattgtgtaagagtatctgttttcccagggccacccagacattgggcttaataatttttttaaatttttactagttttctaggtatataatggcaccttggggttgatttaatttggatttctttaatacattacaacgttgtacactatgtgatttagctttcaattatattctgtcttgtacattaaaaaatatttcatgtgttaatcttatctctccaactagattgtataagctctaaattgtgtaacctgaaacaaatgacttagcttctatgaattttatttcttatgaaatgaaatgagggggtgataatctgtaaggttacttccattgttacggttctaattgcttctctttcctccaaatttttttttttttttttttttttttttgagatagagtcttgttctgttgcctaggctggagtacagtggtgcaatctcaactcactgcaacctccacctcccaggttcaggcgattctcctgcctcacgctcctgagtagctaggaatacaagcacccgctaccacacctggcaattttttttttttttttgtatttttagtagagacaggatttcaccatgttggtcaggctggtctcgaactcctgatttcaggtgatccgcccgccttggcctcccaaagtgctaggattacaggagtgagccacagtgcctggcatcctctaactcttgattcagtactcagactatcctaaattctctgcattcatatgttttacctgttgagtacattttctgcagaatagccaggcagatattttaagaatgtaaatttgatcatgttacttgcttaaaacccttcaatgaattttcattgctcttgggatatataccaaattccttattatacacagaattgcatgatttgcccagtttatgcatcaattcctgctattctttcccttattctcagtgtttcagcctcaaggagttcctcctaacatatgcccttggtctctttttttcatatgggagtggagaaaaacttctattcatctttcagattttagcaaaaatgtctcaaggaagtttagatcttgacttagtaattgtgtaaccttagacaagttatttaacctctctgagccttgattttcaagtttataaaatgagaaaagcctcccttctagagttgtggtaaggattaaatgagataatacatatgaaaagcttaaagaaacatttggcacatagtgaataacacttatataagtagaagctggagaaggagatgctcaatatataattgctgagagagaatgcacgaattaagagaagaaagagttggtcatggaaggttctgtgggtgaagaattttttctttttactaattacttcattaaaaaatttactttctagttagacagatggtgaaaaaaattgtacctgatttcagcagaactcggtgtgtacctataatcccagcttcttgggaggctgaggcaggaggacagctgagtccaggagtttaagacaagcctgggcaacagcaacaaaaaattactgattgcctattttgtgctaggcattgtgctagtactaggtggctctgattttaatagatggtaaaaagtgagtaggcagtcttgaggacaggaggaagaatttgagtcaagattcagcccaagagaatagaagatgggttagaagagtgttggctgctggccgggcgcggtggctcaagcctgtaatcccagcactttgggagtccgaggcgggcggatcacgaggtcaggagttcgagaccagcctggccaacatagtgaaaccccgtctctactaaaaatacaaaaattagccaggcgtggtggcacgcgcctgtagtcccagctactcgggaggctgaggcaggagaattgcttcaaccggggaggcagaggttgtggtgagccgagatcatgccactgcactccagcctaggtgtcacagtgagcctccatctccaaaaaaaaaaaagtggtgggtgctaagattagacaggtaaagaagggacccaggtggtgggtcctagggcaaggaagttataatttggtcctgtgtatagactggtaagccttctgaggctaaatatgtctcagaagattaatgatatctgggcttccatttctgttgcagaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactggtaaaaatatctatcttatacttggtggcagataaaaacactcatttgatacttacaacaacccagtagagtaagcaaagtgtcatcaacttaatgcctcaggtgaggaaaaatacctcaaggaagctacatgacttccttcagatcacataactagtatgtgacagagctgacattcaaagccaagtgtcctgacttctagtctagtgttcttggctttgtagttgaagagggagaaagggcattggcaaatggaagagaacaagactgagtagctttcttcctcattcttgctttggaagacaaatagtattgggtttttcaccaccactactaccactaccattatcattatcttttacagagctgtgtgccagaaactatgcttaagtgcttaacaaatactatctcctttgatgcttataataattatgaaagcactatttgttttcctcattttacataggtgaaaactgaaattctgagaagtcaagtgacatatctgaagtgaaacaactagctagaagcaaggctgagattcaaacctaggcagtataattacagagcttacacacaaccatgacactctattattcctctaattccttaccttggcctctcaacaggtttgtaaaataggaattcttagtttcattttataggtgaacaaatgaagcattgaagggttatgtagtgaataaggtcatagagtgaataagtggtagagccaggattcaaattcaagtctgcctgactccttgcttgtaccactaggccatgcagcctccccagcaggaaatttctaagactgcttctcccaggaatttagctgtctaggagatactactataccgaatccaaataggacttagaaattccaataattggggtgttgcttctgccacaatctatgagcactcagagttgatctattgtttttgtattgttttgttttgttttgtttttttggagacaggatcttgctctgttgcccagcctggagagcagcggcatgatcttggcttactgcaacctctgccctgcctcccctgctcaagcaatcctgccacctcagcctcctgagtaggtgggactacagacatgcaccaccacgtttggctaatttttgtattttgtatttagtattttttgtaatgatggggtttcaccatgttgcccaggctgttctcaaactcctgaactcaagcgatccacctgtcttggcctcccaaagtgctgggattagtgtgagccaccatgtctggcctgattaattatttaagctagccaataggagcagcttggatgcttcatgggagagttaaattgaaactcactcaatatctttgcccagtttgtgtgatatattgagaagagccttaacctgagagacaagaaatttaggttctcctttcaactctgccattaacatgttatataaccacagacaaggcatttaactaagagtcagtttcctcttccataaaatggggataataattctatccttgtttttctctctagattgttgtaagaatcaaatgagataacgttgtaaaagcacttatttgtttattggaaaacactgtataggtgtgagtggtctattattatactaccattgcttagttgggggccagtttgtcactgaaattcactgtccattgtgtctgttgagactctctttagcttctgctctagagctttatgcttgagctccagccaacacttgggctcatttcccaggctctttaaagatcagaaaacctttaaagatcttcaaaggaggccgggcatggtggctcatgcctgtaatcccagcactttgggaggctgaggcaagagggttgcttgagcttaggagtttgagaccagcctgggcaacacagtgagacccccatctctatttcacaaaaaagaaagaaataggctgggcatggtgcctcatgcctgtaatcccagcactttgggagaccaaggcaggtggattgcttgagctcaagagttcgagaccagcctgggcaacatggcaaaactccctctctacataaaagacaaaaattagctgggcatggtggtgcacgcctgtagtcccacctacttgaaaggctgtggtgggaggattgcttgagcccaggaggcggaggttgcagtgagcacagatcacaccactgtactccagcctgggcaacagagcaagaccctgtctcaaaaagtaatagtaataaaaataaaataagaaaaataaaaagaggaaaaaaaagatcataaaaggaaatgcttgtatctgaatttgttccctggtttgaaagaactcaggtgcctaatggaaaacagaatacacaggccagagttttcaatcactggagagttttccagaatcctgaggccctttctttctagagacaccagttcccctaccacccttacctgaacaggctctggagagcctctctttccccatctgtaaaatgagaggagtagactagatcagcattttccaaagaatgcttcaggaactgctaattactggagatattagtagggggcttcttaattcataaaatgattgagtctgagaaacactacataataaattgcctttgtgtgagattcccaatgtgtattagcatagtaaaatctccaagatgtcctatattagagatacctgattaattttgtttaacataggatttcctgaatttattgaagccccaaacactttttgccagcatgctattgatatcacaagaagcagtattccatggaacacccactggggaagcactggattaaataatctctaaatttacttccagtgcaaaattctgtaactcaaaaacaagacatcctcactccatttttacattggtcactccctcaacaagaattgttaaagatattggatactcagggctgcattaggcattatggatatgggggtaaaaaggcaggagacaagtaccatataggcaattactatttaattattttatgtttatagtaaagcaaaagcaaaatacaaataaattgcattttattataagaaagtaaagtgcaaatatgccggatatgtggttacatccctttgttgcctctatatttttaaatgatatgcttatactgctatttttcatcatttttaaagaaagtattgatttcttactacgatagataagaatttagttcttatatacctctctaacttccttctctcttcttctcaatataattatagctgttttctagttaatttaaaatcagtttacataagaatagcatactgtggttatatttccttttatgtacggatttttatttactctgaagttaataattgcttactgggctgggtgcagtggcttatacctgtaatcccaacactttgggaagcagaggcgggcagatcacctgaggtcaggagttctagacaagcctggccaaaatagtgaaacctcatctctactaaaaatacaaaaaaaaaattagctgggcatggtagtgcacacctgcagtcccagctacttgggaggctgaggcagaagaatcgcgtgaacctgggaggcagaggttgcagtgagccaagatcacaccactgccctccagcctgggtgacagagcaagactctgtctcaaaaaacaataaaagtaataataataattgcttaccgtttttctttttgtactatttaagcctttatcatatatttaatattttccaatctcactatcatatgaaatcctccttttcctcccaaagttctccctcttggagctcacttctttctgttctaattcttactaatgcttttaaaaatgacatcttttctgtgattcgctccaattgatatacttcttatagaaacacattatggctttcttcttaactttatgtcatttagacagctatggtggcattaacaagccacatttgtagctagtttcttgttttggaacatacattgtgtagtcattgaaattatccacaaaggaaatggtgctcttaggaaagtactcccattatccaaaatagaaccatattaaggaataatttggccttttacttttggcttgacacattgcaaatgttcacggaatagtagtatttttagaacttgaagtgaccgttagagtccatctaggccaactctcttcaaagattggtagattaagggacaaagaagctaagtgatttgcctaagggtcatacacctgtttgaagacagaactgagactaatctccagatactctcactcctagtcaactattttttttcactcgtgacactacctcattattctagtagtccagcacttggctgtgacagataaaaagagaaattagccacattagccaaactgatttaaattaactttaaaataccagataaaatgtgttattaggtttaaatgtcccagaccctagtctcatggaatttacattctatttggaaagaccaaatagattggccgggcacaatggctcatgcctgtaatcccagcactttgggaagccaaggcaggtggatcacctgaggtcaggagttcgagaccagcctggccaacatggtgaaaccctgtctctactaaaaaatacaaaaatcagctggatgtggtggcaggtgcctgtaattgcagctacttgggaggctgaggcaggagaatggcttgaacccaggaggcagaggttgtagtgagccgagatcgtgccattgcactccaccctgggcgacaagagcgaaactccatctcaaaaacaaaataaaacaaaacaaatagatctacataaaaacagcctgggccaggcatagtggctcacgcctgtaatcccaacactttgggaggctgaggcgggcggatcaccttaggtcaggagttcaagatcagcctggccaacaagacgaaaccccatctctactaaaaatacaaaaatagccaggtgtggtggcgcactcctgtaatcccagctacttgggaggctgagacaggagaattgcttgaacccaggagacagaggttgcagtgagccgagatcaagccaatgtactccagcctgggcaacagagcaagactccatcaaaaaaaaaaaaaaaaaaaaaagcctgaaaagaattatgggccaaactgcaaagagctacttacacaaatagttcacagaaaggaaaaagccttatagggaggcaggataatataaagattaggagaatgggtgttttggtgtcagactaacccagtttgagtcctatttttgccactaattagctgtctgatcttgggcaagttacttaacctctttgagcctcagttttctcaactgttaaacgtggataaaaatagcttttatctcatggagttgtcagttttgtaagattgaataggataaaaaaaaacatgtcaaattcctggcacattgaatgcacttaaatattagccaccacaattatttatattggaacagtgagaagaccaagcatgtttagagtaaaaggtttatgcagggaacaatttattcattcaataaatgcttactaagaacttattaagtgccaggcactattctaaacaaagttcttgccctcatggaggttatagtccagcttgaggagacagacaataaacatagaaaccagtaagtatatgacaggtagtgatgagtactatagaaaaatatagagcagagtcaggggaaagggaagtgacagtgcagagtgggagctgataaggaaagaaccttttgataaatatgacatttgagcagagatctgaaggaaagtatggagtgtgccacgcagatagttggggtagggaggggaaatgttccaggtaggtggagaacaaatgtgctgctgcctggtgtgtttgaagactagctaggaagttagtgtagctaaaatgtgtgagctagggaagagagagtagtattgacaccagcaggatattagatcatgtcacatcttgaaagccaatgtagactctggccttttattcatggtaaaatgggaaaccactagacaatcttttttttttttttttgagacagagtctcgctctgttgcccaggctggaatgcagtggtacgatctcggctcactgcacccgccatcatgcctggctaatttttatatttttgtattttattttatttttttttgagatggagtctcgctctgttgcccaggctggagtgcagtggcacaatcttcgctcactgcaagctctgcctcctgggttcacaccattctcctgcctcagcttcccgagcagctggtactacaggcgcccgccaccatgcccggctaattttttgtatttttagtagagatggggtttcaccattttagccaggatggtctctatctcttgacctcgtgatccactctcctcggcctcccaaagtgctgggattacaggcgtgtgccactgcgcctggccaatttttgtatttttagtagagacaggttttcaccatgttggccaggctggtctcaaactcctgaccttgtgacccgcccgcctcggcctcccaaagtgctgggattacaggtgtgagccaccatgcccacccacaccactagacaatcttaagcacagacgtgataatgatttggcttctatttaggctctatcttttatattaagaagagactgtagaaggggaaaagtagaagcagggtaaccaattaggaggctattgtagaaatccaggtgatagattgtggtgatttagaccatagtagtagtcatgaagatggttagatgtggtcaaattctggatctattttgaatgaagaacctatggaatttgctgacttggattgggtctggggagtgaaagaggagttacggttgtcatcaacagcggatgaggtccaggtatgggagatcttgactatttttggagatctgtgaaaggattgcatgcagcggaagtcgcagcagaggttaagaggattcatctggatacatatggaaatgggaatgtgaagccagagaactgagagtttgttattcagtcctgaactaggatgctgctggtgggaatggaatggaacaatgacattttagagtgatttgataattttacagtaatttaatctgtataaagggcttagtgcttggcagaaagtgtattagctatttttttcattatggaaagaaaccagcacaggtaactaggtgtgtagatggtggagagacagggagaaagtgaaaggaaagagtcaaggattctcctagtctatataaacactgcctcttttgaaggcacacgttcatctgctccaagggctaaattttccctgcaaaatacagactttggttccaactttctcatgctgtcttccccctggtgtggcagataaatatgttagtgggggtgcatgtgtatatgtatgggaaaatgatcagtgacaaggtattgggatagtcattcagggagagagagtcagtgagggtgttagaggtagctgaaggagtggaagggagttagctagttgaaggaacactggaggactgtcggggatttgggggattaagtaaaaggtttataaggagagggtggaaagagtggttgatggctgatattctgatcatttatactagctactcagtctctactttttctagaagtccccagtaaccaaagcccaacacatttggtatcgttgattccttccattgtttgctttgctttgggttgcctaaggctgtggttatctctgagccacctaaattctcaccctcagctgaaatcactactgtctcttcatggctctcagtatatttcaatccttcttcaggaactggagcttttgagaataaggcaactttaggattgaccctaggacagaagctctgctctcaggatccttgtatgctcctgaatatgaattccatagtatgatatttggagctccccagatccttgtaggcatatgtgtgtgtgtgtatttgaggccaaaaaaaaaaaaaaaaagtccctacctccccatgtcactgaagtgaactccagaatatggacctagataatttagagtccctggacatgaatgataggacaatatactctagggctctgattttccatatcaccttgacaaatctccttgacaaaacatgggcttgcctcaccttctcaaccatccccaccttctcaaatacacacactacatctatatctttactagtttcacaacagcatatctattgattaagatatatttggtaaagaaaaacactcattttgagaaagatgacttcagaccattctcttcctctctctgggccttctctttgtgggcatgatgggaaatgaactacagatactctgcaaggtccctttcatctctaatcttccagaattctatgactgtttctgaagagaggaagcagtttttagaagttctgttgcaacctgtagtgactctgtggtgactcagtaggcgggttgaatttctgttgagatggtaagaaagagggaggattttgtttatttatttatttatttaatttattttctataatgatgttgacaccataaagcaagaattttagaaggtttggaatgaaggggctgaggaaggagtctgttcctcttgcctgagggttgtttgtggctggtagcataaatactcaaagctaatgggagatacatgggaaatacctgttgttgggaacagtctttctccacttgaatgaggtgagcagattgtggaggtgagctggaggatttcatgtttaaggtggatttctaacctgcttctctcatttctccctgagttttatgacccttgacactttacagaacacctccctaaagtggtgaaaatgagacaagtaggctgtactttccgagtcactttttttggaagtaggtggcatatgaataataaatgtattgctctgaagactctgtcttgaggcctgtttcagtgtcctgagcttcatatcagctacctgagtttgtgtctgggccaacttcttatactggcatgttcagtaaacatttaatgaaaagaatggctttagttaatgcccttttctaagccttctttttcccacttataaactgttagggatgtacaagactcttttttaagttacttctggcactgaccttcagaatttctgtcacaaatgcagggaactgcctggataaattctctacatttctgggagaagttaggggagaggaggaactggcctcctctcctttgaagatactaggtggtcagatgggagcaggggttcttgccttatggcagccccacatttataacaattaactcagaaggcgtggagttgaggatgggccttcccccacttcctggatttggtttgggagaggttgggcactggtaatgatccccggtgtctcacatcttgaacctctgagaattcaagactctcagtttcagtccttagaggtcatttggtccaattcccacacaaatcaggaattgtagtaccaatatcccaatccctaacaatccccataagttatcattctgattctgggtcattctcattcaattcctacatctctaccttaatacttactagttgggcaagttacctcacctctttaaacctcaattttcatgtctgtaaaatggaaataataagtcctgtgacatagattgttgtaaggaagaattggaataatctatataaagggcttagtgcttggcaaaaagtgtattagctatttttattattatgccaaaaccctatacctaaaacaggtaacagcggtgctgatctggttggagcatggatgggaggcctagagccacattctgtaggcttctccaccctgttactgtgttccctgtgaggtgtgtgtctggaatccctagggatttgcaaagctcagtttgaaaacccctgatctagtccagtgttcttgttttataaatgaagtgatactgagtccacagtctcaggttcctcatatgatgtggcttcctaaacaaccatgtcggtctcccctggatatactttagttggccaatatctctcattaagtattccagctatggtctgacttgaacagggtactattaccattctttcactttacatatctaagattatattagcctcattgacagccacactctccagtcagtttataatctctcataatacttaagattttccttttctttctctctttctctctccttttcctttttcctctttctcctttcatttccttccctttccttcccttgtttgtctcactctgttgctcaggctggagtgcagtggtgcagttgtggcccactgtagcctcaaactccaaggtccaagtgatcctcccacctcagcctcctgagtagctaggagcacagtcatgcaccaacacaatcagcgaattttatttttatttttattttgagacagaattttgctcttgttgcccaggctggagtgcaatggtgtgatcttggctcgctgtaacctctgcctcctgggttcaagcaattctcctgcttcagcctcctgagtagctgggattacaggcacacaccaccatgcccagctaatttttttttttttttttttgtatttttagtggagacgtggttttgccatgttggccaggctggtctcaacttcctgacctcaggtgagcttcctgcctcagcctcccaaagtgctgggatcacagacgtgagccgttgtgcctggccagcttggaattttgaattagagaaggtacaagagaagactgcaaaatctcagatataggagggccttggactacctattatctctttttgggatataaagtttttagaacagccctcttctagggttctaaggtctggtctacttatggttttactatcatggtttattatcatggttaccttatggttttaccatcttggagcatcattattttatttaaataaaataaatacaaccctgaaactattcaccctggaatactttacacacagagttgcccgtacagaaaacatctctagagcatatgaacacctgcatttctaagtgtgatttttttgaccagagactaatttttgaaaccaacgtttgcttctttttgaccatgatattttaatacatgaaaatctatccaaaggagcagtcacagagggttcttgttgaactttagtttctgagctgcttttgaggatggttacttgaggtgtcctccaaactgccacatatagtgagttagagaatctgccaggcacagtggctcatgcctgtaatcccagaactttgggagactgaggagggaggatcactgaactcaggagtttgagatcagcctgggcaacacaggtagaccccatctctataaaaaattttaaaattaggccaggcgtggtggctcacacctgtaatcccagctactcgggtggctgaggcaggaaaatcgattgaacctgggaggcagaggttgaagtgagccaagatcatgccactgcactccggcctgggtgacagagtgagactctgtctcaaaaaataataataataaataaaaaattagctgggtatggtcatgcatgcctgtggtcccagatatttgggaggctgaggtgggaggatttcttgagcctgggaggttgaggctgcagtgagcggtgatcgtgctactgcactccagcctgggtgagaccctgtctcaaaaaagaagttagggagtcctaatacaacatctggatttgttaaaaatctgtctagttgttttcatatgatgggaaacaaactgacagaaatctaattttatttatatggatagccatgctgtacttgctaagaccacaagaataggctcagagagaggggaaagtttgtgtaaattatacattgaattaggggtaaacaatctagtctgatgactccatattcagagccagggtttcccaattttagtttatgtaaataattacctgaggatgtcgttagaaatccagatttctggaccctatcccagactattgagttagaatctccagaggataagacctctgacttgtatttttgtaacctcctcagacaattctgatgttggggggagggacaaagtaccattgaaaaattatttagattaataaccttaaactcttaaaattatatacctaaaagaattttgaaaaattatgtaactcttgacataatgttcatatctaaaaattttatcataagatttaaaaattgcaaaaaatcgaatttccaaaacattttacatattatatacacacatatatatatatgcacatataggttatacctctttcaaaacattggcactgcaaatttagctcatataatttatagaagacatctaccatacaacctgttttgcatagccagttatcacccaacataatcagccaaatcagatctactgtgttagaaattgcctaacttctttcttaagataaatatgttaatatatgactctgtgataactgtttcacttctgagttgtaattctaagagatataaggcaagtagtcttgccatgagtttgttacgtggatgaattaagatgccaattctttcaatactgatttctcagagaagctctcattgatttgctttcttggggctctccctcagaagttatacattctcaaattgtccctttgtttaacactttgttcataccctgtcattgtaccataataaagtttgagataagagagagctatgacattcttgtttaacgtgggagaagggtaattgtaaaagagagtgagaaagaagaaccaactcagacagatcattgttaggaaatattacatatggaagttgaggatctagacatttattctcttcatatttttctgtgcaggtactcacaggaatagagtaccgtagattgaggactaatgatttaaactgcctttgacctagataatagagaaccattgtaatgaatatttttgcatgtgtctattatacttgagagacttgatgtacacataaaatgatgcccctggattttctttccactttctgtttctgctctaggcatattcctcttttgggctgcattccaaatgctctgccctcattcacttgttataggtaaggccagcatgggacacaggatggtaggaacaagtgtgtgattcccctcctgtaagtaggcatgtaggcagtgagaaaagagaagaggtacacaatccatcgggcaccaaagccactttggccaaggggaacatgcaaaaggtatttggatcaaggcctgaaaatagctggcaagaggacagggtacaataatagcccagactgcagggcaggagtcccatactctgaacctcagctccagggttctcttccagcctcttcacagagtcccagactgagcccactgtaggatctcaagaaacacttcttgacatgattccaaaatccattccacaaattccactcttgtctttcctctgcctgtccagcatctatcttgtttatctgtatcctatcttatcccctctccttccatactttctctctttgatcatcttggatccagctggtcatataagcagagataagtttgttcatttatttattcattcttttatctattcattttacaattatgtattaagtgctcactgtgtattggcctttgtggtaagcactaaggagaaaacatataaaaagatatcctgtctgccattaaggaactcataatccagtgagggaaacagatgtctacataggactctagtgctagaaaaaaataagtgcccaagtgttgtctttagaaataaacaggctgggcgtggtggctcacgcctgcaatcctagcactttgggaggccaaggcgggcggatcacttgaggtcaagagcctggccaacatggtgaaaccctgtctctactaaaaatataaaaattagcctgtggtggcgggggcctgtagtcccagctactcgggaggctgagacataagaattgcttgaacccgggaggcggaggttgcagtgagccgagatagcaccactgcactccagcctgggcaacagagctagactgtctcaaaaaaaggaaaaaaaaaaatagaaagaggcaagaatgaatgaatgaatagtgcttaatctttctaatgaatgaatagttacaacctttctggaaaggaaggtttgtaaagatgtctgtattttccaaattaatctgtacatttattgcaattccaatcaaaattgcaattatattttttattgagatataatttataccatataattcacccatttaaagtatacaattcatatttttaatatatttgcaaaggtgtacaactttcaattttagaaaattttcatcacccccaaaagaagtgcaatactcattagcagtcatttttcattttcccccaacttcttctcctccagctctaggcaaccactaatctactttctgtctctaaggctctgccttattctggatgtttcatataaatggaatcatataacacgtggccctttgtgtctggtttctttcactaagcataatgttttcaaggttcatccatgttataggccggatgcagtggctcatgtctgtaatcccagcactttgggaggctgaggtgggtggatcacctgaggttggtggatcacctgagcttggcagtttgagaccagcctggccaacatggtgaaaccccatctctactaaaaatataaaaattagccggccatggtggtgcatgcttgtaattccaggtacttgggaggctgaggcaggagaattgcttgaacccaggagacggaggttgcagtgagccaagatcatgccaccacactccagcctgggcaacaaagtgagactgtcttaaaaaaaaaaaagttcatccatgttataccatatatcagtacttcatccttttacattgctgaataatgttgcattgtataactgtatcacattgtgtccggaattggtgggttcttggtctcactgacttcaagaatgaagccgtggaccctcacggtgagtgttacagctcttaaggtggcacgtctggagtttgttccttctgatgttcggatgtgttcggagtttcttccttctggtgggtttgtggtctcgctggctcaggagtgaacctgcagaccttcacagtgagtgttacagctcataaaagcagtgtggacccaaagagtgagcagcagcaagatttattgcaaagagcaaaagaacaaagcttccacagtgtggaaggggacctgagcgggttaccactgctggctggggcagcctgcttttattctcttatctggccccacccacatcctgctgattggtagagccaagtggtctgttttgacagggtgccgattggtgcgtttacaatccctgagctagacacaaaggttctccacatctccaccagattagctagatacagagtgccaacacaaaggttctccaagtccccaccagagtagctagatacagagtgtcaattggtgcattcacaaaccctgagctagacacagggtgctgattggtgtgttcacaaaccttgagctagatacagagtgccgattggtgtatttacaatccctgagctagacataaaggttctccaaggccccaccagagtagctagatacagagtgtccattggtgcattcacaaaccctgagctagacagagggtgcagattggtgtatttacaatcccttagctagacttagaggttctccacttccccaccagactcaggagcccagctggcttcacccagtggatcccgcactggggctgcaggtggagctgcctgccagtcctgcgccgtgtgcctgcactcctcagcccttgggtggccgatgggactgggtgccgtgagcagggggcggtgctcgtcgggggggctcgggccgcacaggagcccacggtgggggtgggggaggctcaggcatggcgggctgcaggtcccgagccctgccccgcgggaaggcagctaaggcctggcgagaaatggagcgcagtgctggtgggctggcactgctggggtacccagtacaccctccgcagctgctggcccgggtgctaagcccctcattgcctggggccggcagggccggccggctgctccgagtgcggggcctgccaagcccacgcccactcggaactccagctggcccgcaagctccgtgcgcagccccggttcccgctcgggcctctccctccgcacctccctgcaagctgagggagccagctccggccttggccagcccagaaaggggctcccacagtgcagcggtgggctgaagggctcctcaagtgccgccaaagtgggagcccaggcagaggaggcgccgagagcgagcaagggctgtgaggactgccagcacgctgtcacctctcaacgttatcacatttttttctttctttctttctttccttctttctttctttctttctttccttccttccttccttccttccttccttccttccttccttcctttctttttctttcttttctttcttttttgtttttttttgagatggagtcttgctcttgtcgcccaggctggagtgcaatggcatgatctcggctcactgcaacctccgcctcccgggttcaagcgattctcccacctcagcctcccgagcagctgaggtacaggcactggccaccacgcccggctaatttttgtatttttagtagagacggggtttcaccatgttggccaggctggtcttgaacacctgaccttgtgatccacccgccccagcctcccaaagtgctgggattacaggcatgagtcaccacacctggccccacatttttctttattcattcctcaattggtggacatttgggttgtttacactttctgatgtcatgaataacgctactacaaacctttgggtacatgtttttgtgtagatgtatgttttcaattctcttgggtatatagctaggagtttaattgctgagtcatatggtaagtctatatttaacctattgaggaactgccagactgttttccaaagtagctgaaccattttatattcccggcaatgtatgaggtttccaatttctgcacatgcttgtcagcacttgttactgtctgtttgtttgattatggccatcttagtgagtgtgaagtgggatctgattgttattttgatttgtatctccttgaccatgcctgaccttttttttttttttttttttttgagactgagtctcgctctgtcgcccaggctggagtgcagtggcacaattttggctgattacgacctctgcctcccaggttcaagagattctcatgtgcagcctcccaagtagctgcgactacaggtgcgtgccaccatgcccggctaaatttttttttttttttttagtagagatggggtttggccatgttggccaggctggtgtcgaacttctgacctcaggtgatcctcccaccttggcctcccaaaatgttgggattacaggcatgtgctactgcacctggcccattaactgccttttgaagactggccggtacagtcctggctccctcaataggtgaggaatcaatgtttagggagaaatttcataaatagtccactgattgaggctatttactctagtttcatcagttttgagttggtgaaaagcccgtccaaatttgggtgataggatgacagttgattccagtttttgaatcaggagctgagtgaggctgcattagggtctacaagttagatatcatttgaaaccagaaatctgtggtgttttcaaaaggaactttttctaaggaactaagggaaaaccaaacagaatgatgaatttctgttaagtacactaaaattccatccttggtagttgtcaacctcacagttctcagagttcctacatttttatttttttccttatgctaattctgaatttggaaacaataccccccttttggaggccatgtcatttaggaggagaaggccctgaactagacatttagactcaagaactgtgctatccaacatggaagccactagctacatgtaactattgatatttatagtaattaaaattaagtaaaataaataatccagttcttccgccacatttctagtgtttgatagctatatgtggctagtgactaccattttggacaacagtgctttagaatagtgttgctactaatttgtaagtaaccttgaggtcatcactttctatttctgtgccataggtttctcaatggtaaataagagtggtgagtctcaaaagtaccatcctcttctggaattctttctttttctcttttcttttctttctttttttgacaggatcttgctttgttgtccagtctagtctctaactcctagcttcaagtgatcctcccacctcggcccctaaagtgttgggattacaggcatgagccaccatatctggccctcctctggcattctgagtaatctgtggttcagtttttggggtgtgcctccatctacctcctccttcagcccttcttgatacttactgcagctagggcagaagcacccagagggaacattaggctgctaattagtcaaggtacattgctcccattccctggtgaaagggaaattgacttgtgggtatacttatatcttgagtgctccacaattgtgcagtgctttatggatcacagaactctttcacattgttttttcattttatagaatcaaagaatctcaaagttggaagggctgtaaaggtcatctcaaacttcaataaccatgaattatatggggagcttatgcaatgaaaatttcaaggccccactccctggagaataatctagtagaagtaggtgtcagggttaccctggcccaacctgaacaatcctgtgctgcatgggaacttggtactgcattattaacactatctgaccactctttgagaaacactggtcttgcttggtccccagccatattgtggaggctgctctttggtatcgctacaaatcccagattcaacatgatatctccagggtcaggaaactcctgaaggagtgccttccatctttggacatctctaacagaaaggttttttttttaatatggagctctcccaattgatgtagattttccatttatagttatactacattagtctacttttccccataatgatcctttagattcatgcattcattcagcaaaaatttactgaacacctattatatacaaggttctgtacgagacaatgagggattcagcagtgaacaagaccaacttggcctctgccttcagaaactgtcttctgtctagtagggaagataggaaattagcaaaaataataataagtaaacaagtaatattaattctattaataatattaacaataacaataagtaaacaaataacaaaagaagtatagtttgagaaaaatgctgtgaagaaaataagcagtgttatgatgaataacaagaagagctgatctacttagggtggtcagggaaagcttcactaggaagtgacatttaagctgagatttgaaacacaagaagagttggggaaagatagttaaagaatatggcatgttctatcagtcagaaggccagcatgtttggagcctagtaggcagaataggagaatggcacaagatgaagttggggaggatacaaggcatagcaggagtgcggattttcttctatatgcagtggaagctgttaaagggttttaagcaggaggtgatatgatctgatttgtggtttgttttattgttgtttaattaattaattaattaattaattaattttgagacaaggtctggctctattgccctggctggagtgcagtggcaacatctcagctcactgtaatctccacctcctgggctcaagtgatcctcccacctcagcctcctgagtagctgaaactataggcatgtgccaccacacctggctatttttttttttttttttttttagtagagagagcatttcgctatgttgcccagtctggtctcgaactcttgggctcaagcaatcctcccaccttggcttcccaaaatgctgggattacaggcatgagccaccatgcctggccaatttatgtttttaatagatcattctgtggccgggtgcagtggctcatgcttgtaatcccagcactttgggagccaaggcaggcaaatcacttgaggtcaggagttcgagaccagactggctaacatggtaaaacttcatctctactaaaaatacaaaaattagccaggcatggtggcatgcacctgtggtcccagctacttgggaggctgaggcaggagaatcatttgaacccggcaggcagaggttgcagtaagtcaagatcacaccactgcattccagcctgggtgacagactgagactctctcaaaaaaaaaaaaaaaaaagatcacagatcatgctgggtgatgtgtggactggaagggaacaagagtgaagtgggaaaccagttaggtgggcattgtggtcatccaggcaagagatgaaggtagcttgaccggggtggagacaatgaagatacagatttttgagacttgctatcacatctctcaatatcttctcttccacaaaataaacagttcagtgttcctctcatctcctctcataacaggtttggtgtctcttctcacctgggtgtttctcctcctgtttctcctccatctgattcctctgtaaagaactcagtctttccctcagctgtttcttcctatcctgtgccttgcttgtagttctagggaattaaaatcttcaattcaatgactatcgttctcatataaagaggggagctgggtgcagtggtgcatgcctgtagtcccaactactctggaggctgaggtgggagaatcatttgagcccgagagtttaagaccagcctgggcaacatagtgagacattgtctcaaaaaaaaaaaaaaaaaaaaaagttggggggtagcaccagtcttccctgtcattagtcaattaccagtctttcaattattcaaccatgaccctcgaatacctattgtgccaattgtgcttggaggagacagagaagaagacatgatctctgccctccaagagctcagggtataatgggaaagataaggcccaaataaatataataaaagctagaaaaacagatcacaaagaaagtgagataaagggctttgggaggaagaaagaacttttagcttttgggtaggtgagaaaaagagaaactaacaaaaatttcatggaaaatgttaattcagagaacctggggctggagaggagcgcagggagtatttttttttttttaatgtggtgatcaaagataaccttactgagaagccaacatttgagcaacgactcaaagatagggaataagtcatgtggctatctagggaaagaacattccaagtagagggcaaaggctctgaggttaaatgttcttggtgcttttgccaaacactggggaggccgtttggctggagcagagggaaagggagaggaagagagaatagttgtatgtgaggacagagaggaaatgagggactagatcatgtaggccattgtgaggactttgacttttactcaaaatgaaatgggaagtgatctgagcattctgagcagaagggtgacataatctgaactacctaatggtagttttggactaggatggtagaaatagatgtgaagagaggtagtctaattctaaatggattttgaatcaataatgggttaaagtaaatttcgagagtgtgagaatgaagtagttggagaagactccttggaggaggttccctaggggaagaagatgagaaggactagtgactgtgtaccatgggttgtcacaccaaccatatggcctccaggtgaaggaaaagtagtttggtttataccaagggttccccatgttatcccaccagctaaatttctcattaatagttttgtttgattcacagtgtttaaaccttttttttttttttttttttttggtaggcaggggcgagacagggtctctgttgctaggctagagtatagtagcatcaacgtggctcactgcagccttgacctcccgggcttatgtgatcctcctattttagcctctcgagtagctgggaccataggcattagctaccatgcttggctaattataaaattttttgtagagacaagttctcaccatgttgcccaggccagtcttgaactcctgtcctcaaacagtcctcctgctttgccctcccagagtgctggtattatggcatgaaccactgcaactggccttaaagctttaaaaaaattagtggtcaacacatataaattcagaagttttttttttttttttgagacggagtctcgctcggtcgcccaggctggagtgcagagtgcagtgcagtagtgtgatcttggctcactgcaagctccacctcctgggttcacgccatcctcctgcctcagcctcccgagtagctgggactacaggcgcccgccaccacccccggctaattttttgtatttttagtagagatggggtttcaccgtcctctcgatctcctgacctcatgatccgcccgcctcagcctcccagagtgctgggattacaggcgtgagccaccgtgcctggccaattcaaaagttttgacaaaaatagattccaggctgctattgaaaaatcgaaaaaattgacaacattgagccctgattcctagcaagcaaaagctgacaggaaccaagtttaggtactagatgcctccttttgccagagcatgcatttgccagttttcctgtccttccccttccctattgttcccctgaaactgaggctaaggtttattatacatgtgctgctgttttcttatagggaagtggaaagggaactatttcttatctttatcatatattttctttcatgtggtccacttatttacattccgtgcctagatcctgccaatttttgagcttgcagctcctggtgtagaggaaagaggcctggaccttaagtcgtggtccctgctctgctgtggtaacccaccctgtgatgccaagcatagctaatagcctctttggatctcagagttaagagactaaattggatgttcttttaagagttctgatatcctggccgggcgcggtggctcacacctgtaatcccagcactttgggaggccgaggcgggtggatcacaaggtcaagagattgagaccatcctggctaacacggtgaaaccccgtctctactaaatatacaaaaaattagctgagcgtggtggcaggcgcctgtggtcccagctactcgggaggctgaggcaggagaatggcgtgaacctaggaagcacagcttgcagtgagccgagactgcggcactgcactccagcctgggtaacagagcaagactccgtctcaaaaaaaaaaaaaaaaaagagttctgatatcctagagggcttgggattttgcagtaggccaataccctgcccctcacctttcccaaccagccaggggccccagcctggtgtgtatgtcagagaaagaagacactggaatgagtaaggtgcttatatcaataatgtataacttgagcccatagccaaggagaggaatgcacactgtggtgtgtgtgtgtgtgtgtgtttcacggttggaagtgggctcaaataagttgtacttgcataggttgtgcttatttcttcttgtgcactctctatgtactaggctgtacttgaggtgctagggatgtagcagtgaagaaaacaaataagatctctgctgtcagctgggtgcagtggctcacgcctgtaatcccagcactttgggaggccgaggcaggcggatcacctgaggtcaggggtgtgagaccagcctggccaacatcttgaaaccccgtctctactaaaaatacaaaaattagccaggtgtgatggtgggtgcctgtaatcccaactacctgggaggctgaggcagggagaattgcttgaaccctggaggcggaggttgcagtgagccgagatcgcactattgcactccagcctgggtgacagagcgagactccatctcaaaaaaaaaaaaaaaaaaaaagatctctgctatcatggagcttatattccagtgaagaaaacagataatatataagtaattaacatacatgagataatttcaaataatggaacgtttcatgaaaaaaataaaacagaatgtgttttttttttttgagacagtcttgccctgtcacccagggtggagtgcaatggcgcaatctcagctcactgcaacctccatctcctgggctcaggtgatcctcccaccacagcctcctgagtagctgggtttacaggcatgcgccaccatgcccggctaatttttgtctttttagtagagttggggcttcgccatgttggccaggccggtctcaaactcctggcctcaagtgatctacccacctcagcctcccaaagtgtgggattacatgtgtggcacctggcaaaacagaatgatttgatagagagtttctgaaggggcacactgtgcacataggtggctacatgtatatggtggttgtacttgcagatacagataagtccatgtttgaatcctgggtgcatatatttatccttgtttgtgcctatgtgtgcagatgggcagcttttatgcctagaatgtttgtatatttatatgtgattttatacaagtgagcgcacataggtgagttggtatgtggtttgcatatggggacacatgtgcttgggtatgtatatgttggcattcagccataaccggagacgttctgaagttcctgtggcacttgtcagtgagccagttaaggaaatggcttttctgcctctggcattcagggccgtttgccagcttcctctctccctgttctttcccactttagtaagctccctgtgtttggcttctctcatccctaggagggttaaagcctactgactcatcgagccaggaactggaaaaaggctgataatcttctgtgtgacctctgttagtaagaaaaggcctggcttccctgccagtccctgtccttcacactatgagggagagtcctgacttgaaatcagaagacctgagcatctattcttggctctgccacttattattgtgtgaccaataatctctctaggtttcagttacctccttcataagtgctctgtgcagtaaggaaggagaggggaagcaatggtctgtggtgctaagggagagccagatggtgctggtgtctgaaggaggagggagaatattctgagcaggggcaatgatgtggccaaaagcgtggaggtggacctgaacttgccaagggaaaccagggatccacttacagtaaaattcaaacttcttactattgcctacaaggctctacgtgatttggctgctgcctacctctcattcttacccaacttcttgctcactgaaatctagccatactgtctttctttctttctttgaaaaggtctcagtgccttttcacttgatgctccttttccccagaatactcttcccaagaattagtatgattgcctacctctcattattcaggtcttggctcaaatatcacctctccagagagaggccttccaggaccatcttatttaaagtagttgttccctaatatttatcaatatttaaaatgcacacatcagccaggcacggtggctcacgcctgtaatcccagtactttgggaggccagggcaggtggatcacctgacgtcaggagttcaagaccaacctgaccaacatggtgaaaccccatctctactaaaatgcaaaaattagccaggtgtggtggtgcacgcctgtaatcccagctactcaggagtctgaggcagaagaattgcctgaacccaggaggcggaggttgcagtgagccaagatcgcgccattttactccagcctgggcaacaggagcaaaactccatcttgggaaaaaaaaaaaaaaaaagcacacatctcttgaaccaacaggtccacttctggtaattcatcctacagatatacttgcaggtgagtaaagtgacataaaaataaaaatattcattgaagcatttatttgttaaataaattacagtacatacaaatagtggaatattttgcagctgagaaagataatgaaatagctctttaagcttggcaccgtggctcacacctgtaatcccaacactttggaaggaaggctgaggcaggaggattggaggatcacttgaggccaggagttccagactagcctgagcaacatagtaggatcctgtctttgcaaaaaaaaaaaaaaaaaaaaaaaggtagccagacatggtgactctggcctgtagtcccaactgctcaagaggcagaggtgggaggatcacttgagtctgggaggttgaggctgtagtgagctgtgatggtgccactgcaccccagcctgagtgacagagtgagaccctgtctcaaaaacaacaacaacaacaaataaaaaagagaaatagttctttaagtcttggtgaagaatgatatcaaggtatattgttaaatttgaaaaatcaagatgatcaatttctacacataagatttgtgcattttattgaatgcatataataattaacaaaagatacagaatagtgtgtattgtatgccatcatttgtgtagaaaaaatgagactatgtaaacaaatgcatgtagtatatatgcttgtctgacagacctgtcccttaagtagagcagttcttcctacccctgttaccctgtgcttgactggggactatgaggtgttcatctcttttctgaacaacattaaaatccttttttttttttttttgagacaaagtcttactctgtttcccaggctggagtgcagtggtgtgatcgccgctcgctgtagccttcaccttctgggttcaaatgatcctcccgccttagcctcccaagtagctgggactacaggcgtgcaccaccatgcccggctaatttttgtatttttagtagagatggggttttgccatgttggccaggctggtctcaaactcctgaccccaggtgatctgcctgccttggcctcccaaagtgctgggaatacaggtgtgagcctctgtgcctggccaaattttttttttttttttttttaaacagagtttcactcttgtcgcctaggctggagtgcgatggcacggtctcagcttgctgcaacctccatttcccggattcaagcgattctcctgcttcagcctcctgtaaaattcagttttttaacattcaattttcaaattttggtcttcaatgatatctcaagggtcttattaaagatcataatgatacagacttcttgcaaagtaattattttggtcattccacactagttgaattaccctagccctgtgtcctacaaagaatggtcctgtctgaatattgattgtttctggaaagtcacacagaatattggtaactgttttgccctgggcatggtggctcacgcctgtaatcccagcactttgagaggctgaagcagttttgcttgaggccaggagtttggagaccaccctggacaatatatcgagactctgcctctatgaaaaattttaaaataaaaaaattagccaggtgtggtagcatgtgcccgtagtcccagctactcaggaggctgaagtaagaggattgcttgagcccaggagttggaggctgcagtgagctatgattgtgcctctgtactccagcctatcaatagagtgagaccctgtctctaaaaaacaaatcacaaaacccaaactgtggtttgccagtaggcagggtgattgggagataggagtggggagaacacttctcattatgtatctttttatgtagtcccacttgtatgtattacttattcaaaaaaatcataaaattggaaaaaaaccactaagggaaacatttatttatttattttttgagacagggactcactctgttgtccaggctggagttcagtgacatgattacagctcactgcaggcttgacctccagggtacaagcgatcttcctgcctcaacctcctgagtagctgagactacaggtgtgcaccaccatgctcagctaattgaaaacgatttttttttttttagcaatgaggttttgctgtgttgctcagattggtcttgaactcctggtctcaggtgatcctcctgccttggcctcccaaagtgttgggattacaggcatgagccaagagatcttcccatctcatctttctgagtggctgggactataggtgcatgacaccacactcagctaaaattttttttttttttttttgagacagagtttcattcttgttgcccaggctggagtacagtggcacaatcttggcccactgcaacttccgcctcccagattcaagtgattctcctgcctcagcctcccgagtagctggcattacaagcatgcactaccacacccagctgatttttgtatttttagtagagacggggtttctccatgttggtcaggctggtcttgagctcctgacctcacgtgatccacctgcctcggcctcccaaagtgctgggattacaggtatgagccaccgtgcccagccggatccagctcaatgtttttagagatgcggtcttgctatgttgccaggctggtcttgaactcttggcctcaatagatgggcccactttggcctcctaaagtgttagaattacaggtgtgagccaccgtgcctgacccaagatagtatattttttaaaagtatttctccctagtcactcatttttatatcattctgctctatttataatgcttatcataatctgaaattatcctggttatatttgttatttgtttattacccacactatcattggaatataagctccatgatatcaggtatcttacttatgttgttcattggtgccttatttcttcttttttttgtttgtttgagacggagtcttactctgtcgcccaggctggagtgcagtggcgtgatcttggctcaccacaacctccacctcccttcaagctattctcctgcctcagcctcccaagtagctgggattacaggcgtgtgccaccacacccagctaatttttgtatttttagtagaggcatggtttcaccacattggccaggctggtctcaaactcctgacttcaggtcatctacctgcctcagtctcctagtgtgttgggattacaggaaagagccaccacgccccgcccattggtgccttatttctatacatgtagatagcacatagtagttgttgaataagcaaatgaatgcatgaaggaatgactgaagtaaaccaggctaaagcctaggaaggagtgggaggcaaggctgaggaggtagacagaaatcacctgataaaggatggcgattctcaaactttatttatttattcaagatggaaactcactctgtcatccagactggagtgcagtagtgtgatctcagctcactgcaacctctgcctcctgggttcaagggattctcgtgcctcagcctccccagtagctgggattacaggcacacaccaccacacccagctaatttttgtatttttagtagagacgcggtttcaccatgttggccaggctggtctcaaactcctgacctttgatctgtccaccttggccttccaaagtgctgggattacaggcgtgagccaccgcgcctggccaattctcaagaatcccctactaattccttgtaccatcttgtaataaagaagcagatccttggaccctgtgattctaattcagtatgtttgagctggggcccaggaatctacaaatcctctagatgatttaggcacaagtgatctggagaccctactctgaataatgcagtcttgatgcctcatcagaaggaatcacatctgtgatttcacttctccttaatacattactaggatggaagagaaggggccgtcactccatttcatcaaggatcagagatggacagtgcattttctaatgacatacaacatgtgtataaaatatcttgaatggccaaagtatctgacccgtcagctcaagattggtgatggcaagattgatggtgggcagatagctcatcctcatagaacagttccaggccttagtgtcactgaatggattttatgactctgcctgtttcttgtttggggaagaagttatacccctaatcactggttctttctggtatgtctcagggagggcaatgagccaggggagaccactcagatcacataccatcagcttctggtccaagtgtgtcagttcagcaatgttctccgaaaacagggtgagtgtgggggtgtgggaaaggactgggggtctggccttggggtatctgagtatctgagacttatggggagagggcaagggatggaaagaatttggtaacagaggaagagaacaggtcagctgggagggaggccagctggatgggagggagcaagtagcagcaagaagggttcatggttcatattctgtgcttttacctgcaggcattcagaagggggaccgagtggccatctacatgcctatgatcccagagcttgtggtggccatgctggcatgtgcccgcattggggctttgcactccattgtggtaggagtttgggctggtgaaaaggggcaggcgggggggtggggctctggagaagtaggttgggcctagatgatggagggtcttaaataacaaactaaggagcttagaaggtttgtgtcataggtccatattagttattcagtttcttctaggaccctggcttagagatcctgaaagttccatgagcaacccctttcttcattcactcaatccctggggctttcttctctccctcagactttcttcccttccctagtttgcaggcttctcttcagagtctctatgtgaacggatcttggattccagctgcagtcttctcatcactacaggtgactaattctctcacctcttctccagaaccccccatacctcaagccttggtctccaatcagctcattggtatttggggctactcagcatagagggtagagactgcctgccttttctctcctggtcccacctcagctgaccctctgtcagctcgaatcagctggaagagccagagttaagaggcctactcaggaagggccctatggacattgtgcccactaggcagcatggggcttactaaggcctggaatgtctgttgctccccaaagatgccttctacaggggggaaaagcttgtgaacctgaaggagctggctgacgaggccctgcagaagtgtcaggagaagtaagtgtgtttggctactgtctgagttgactgagcctttccccagtgccaggttccctttgtcccctctaccctaaatggacatgggtgggtcttgccaagttccctttgagccaacaaggctaccactttaggcttttctcttctccaggggtttcccagtaagatgctgcattgtggtcaagcacctggggcgggcagagctcggcatgggtgactccaccagccagtcccccccaattaagaggtcatgcccagatgtgcaggtgagtctggcactgctatgcctttctccaggctcaaattccttcacttttcctgcctagaaaattcttgatgtccttctttgcctgctcatcagtatactgaggatccaggagcaattctaggaatgcctcctctagcagggctaggtgggaactggaagactttgaccttgactgtgggtagagaggcccttgtaccttgagaacatagcacaagcgattgtaagggagactcctatgctggttggggtatccttgtgggcacaggggatcctcagggcctaggcttgtgttagaaatgtctaacttgagtgacaatatatagtcatctccattactaggctgtgatgtggggtgggctatctttgtggcctaagggatgcccaccttggaaggaccagagtccagccctcacaatatggcctttgttagctttggacccccaggcttctggtgggaatggtagaaatgcccagtgatggcctccaggctgagcagcatgagggatcaaagttctggggttgagtaagagtctgtgacttgaggctccctgaggggtcttagggctagagaggctgtagtctagtttagggaagttggaaagcccaatcagtgttaggggttttacatatataggggctggaatcaggatcaggaaaatggaagctgggaggaccagtgagaagggagtttggggtttatgacacactgaccctttcctcccactccctgtatacttggaccctcctcactacccttttcatcctgggctcttaacagggtaaactgaaagagaaatccaagcgtgttcagccccaggtatccatttctgcactgccgtgggcaccgcttctctgtttgcttgtctgtgtgctcatctgccctttgcctgtttgccccattgaggtggctgccagacctaacctccttccccttgcccctgggcaacttgacatctaagccactgaagggtggtgaaattaaatgtccgttactgcctctgtgaattggtatagagtatggatcttagagaggtaacagcagaacacattttatcctgatactcaggacctttgtgggagaggggacaaggtaacctgtcagaaaacatttactgtgcaggtagctggagcagagccgagagacaggaggaggaggaggtggaggaggttcagaccctgactttgggaattcactgtcaagttggggagttagacatgtattattaatacaaaggaaaatctaagttttatacaggacagcagaggagattcctaaatacatttatatagtgctttgggatttataaactgcatataactttgtaatatgattaagtgctaaactgaacaaaagtcatattgtaggtggttctaagaagggagatccataagggggtgctcaaagcagattagtatcgaggaaagagtgggcctgaagtccagagaccaatttttagctgtatgaccttgagtaagtcaattctcccctctgggattcagtttccttatcagtaatggagagatgataacacatgttataaaaggaaacagcttcccttcctaaaacaacacataaagctcactattcctctggattttaccatcttcacagggtgtcttactctaaatctgctatgattaacctcttaggccaatggtagatataagccccttttctctattctcattagcatggcggagacagatctgattcctagggcatactgctttccttttaaaactcaggcaggacctacaccctttcttttgaaagaggtgacaaacttagtggcttaaattgtaatctctggagccagattacttgggttcaaatcctggctctgccatctgctgctgtgtaaacttgaacaaattacttaagctctctcgcttgtttctccatctgtaagataaggataataattatacctatgttatcgggttttgtcaatatatgtaaggtgtttggcacatagtaactactcaataaatgttagctgttttttccttccccttaatgcaacagacagattggcatttctaaaacagagaccagaaaagaaataacaaactcttgtaattcttaataccagagaccttcaggccaaaggctactggatttttgtttcttggaggtgaaaataaccagtttccaaaataccaaagagcataaaaataggcttaaaaagtccaggttgttggtctgagaattgcagtcaaagctgcaaaaatctttctgacaatgggccccatatttaaaaattaaaaaatagttttcaaaagagctgcaaaaatcctggcagggctccaaacccctttatccttaaacaatcttccagggagatcctggcagggtttgcagggaccctcctcaaccatatcgtctatgagctccctcatattcctctcccgtacatggcagctgccctccttgagactatcctggtccaaggacaaaggccaactcctcaattcttattttagaaaattcagaccttttcctggtgcagagcctggggcctcataggcacacacctaattcacaatcaaaggttgctttgctaattgagttcactctgcttcctggtgctagttatcagttccacacctggagtactctgacccctccacctctatatacacacccacccacaaaagaaataataagattataagagtgccctcattgcagagccacagttgtaactatgccttgtccttacatgtacttagtgcctgttctgtggcagttcacagtgctgtagaccagcaccatttgtccaaagcagtattgatacttctggttgaataccttagtgcccccatctcaagtgatcatttggcaggaaaaaaagtacccatgtgacaatgtatgtgtagatgcatatggatagaccaaatcaggtgtgttcttatgttttctaaccgtaggcagctttctctctcttcttcctttttctaggcttgtcgtttttatgatgttgataatccagaaatttcaaattctctaccataaggggcaggtggtacagaaagaacggagtggttagagagtcattttctaatttatcaagctatatatctaacactccagaagtttttttaaccaaatatgcacacaacaaattagcatatatccttataatgggagaatggcatttatcttacaccatcatgtctacctgccagccagggccattgaacatacaagaatctaattaatatgaaaggactttgtgacagctaaagcaaaccccaaacagttcctatcatcacactcttaagtttttgtgggttttttttgttgtttttgtttttgtttttgttttttgagatggagtctcactctgtcgctcaggctgaagtacagtggtacgatctcggcttactgcaacttctgcttcctggtttcaagtgattctcctgcctcaccctcccaagtagctgggattacaggtgtctaccaccacgcctggctactttttgtatttttagtagagatgaggtttcaccatgttggccaggctggtcttgaactcactcctcacctcaggtgatctgcccactttggcctcccaaagtgctgggattacaggcgtgagccaccgcgcccagccccacactcttaagtttaactcccagtagtcactgaactaacctctgtctctcctgacattcatcagtcttcctcatctcaccccaacctctacccttggggcaatccaaggcttgatgtttactagataatacttttttcttttggtgtttaccacatcctgtgagtctgttaaggcaagaatgactgtcctcatttgtaaaaggagagacttaaggtaaagtgatttgcccaaggtcatatagctaggaagtggcagaactggtattgaagtacactgaagattttggacaaattcaagggatctaacttcattcagcagatggtagactcaaaattggtgttcaaagaggtgatatagacagaaaagtaaaacagtttcaaaggagaatttagagaagtttcaggatgacagatccagaagtaattatcaaaggcatagggggacatccttctactgggagaagtccaccttggtccttcttcaccaacttgaagcaaagcttcctgctgaatggaacctgtcccctcaagcaaaagtctctatgggaaaccctattggtaccagtggtgtaaaggcaggagcagagctagggtaggaaacacgcagatgtggattgggtctggacatgtaggcaaaagtgcttggaccaagatctgttgacttattttactactaacagggtcaggtgcccacctcacctgtaagctctgactaattttgcatttctgaattgtgtggtgtccgcatccctgctaatgagcctagtcccataagtacatatgtatgtatgtagacctgtgtgtgcatagtcattcatccaacaaaaattgactgagtgccaggcactttgctaggtgttgggagatatggcaggggtcgggaggaaagacatttcacctccttcatagatgtcgctatctagatggggagacagtaatcaagtagacaactaaacaaaataacaggaaatatgtactgtgtgggaaagaaacatggtgttgtgatcaataataatagcagggttgggggtagcaatctatcagatactgttcaggtaaaggctttccaagaaggtgacatttcagctcagaattgaaggatgggaagggaccagccaagggttcctcctcagcctgaggccaggtgagaggagttctggggtagagatgggggtaggatggcagggtggttggagtactcagtaagcttgggttctgctcctgttctttctgttccattccatccttgaagggccttctctcccttcctgtactcctacctgcctgtcccacctcattccctccaggggcaaggtacgggtgtatcttgtccccatcttgagctgttcacagttcttccctgcccatccctgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaaggcaagtgtgtgtgtgtgtgtgtgtgtgtgtgtgtgtgtgtgtgtgtgtattatgtaggggtaagaagtaagtttctgaggaaacaagtaatgaaattatttttttcctacaaccctgagttttggaaatgtagcattgtcttttctaaatcaaattaagacataaatcctcaatctataggtggtgaggcccagggtgagacagttcaggtggagggttttcatacagctgacatggatgttctttccctatgcacccatggtttggttgaaggagagctattctgttaactcaaggccaagggtgggcacagagatccctctcaggcttctaagaccataactcttagagttcaattccttccacctggcacactattaacatgtagtcctctgccagcacacaccatgggagccggaaacacttaagaaaactgtttcttccattgacttgaaagctatgtcactctaccttctgcccactccacccctaaattatctccatatgctttggaatatccctcaataagtctttagaaacacaattttggcctctctttcatagagatgggggtagggatggaataagcaaagggaattatcttttttttcccactcactctgatggtgtgtaattgagtgtgtgggcacaaatacacaacagagggactattatgagtgtgctatgagtgctcatgtgtgagtgatgtgggtggctctgaaataccatctgagggtgctggtatgaatgatggcctgatagacatatgtgtcatcaggagtgtgataaaggagatgagatgggagcatggagaaaaggagatggaagggagatggatgctgtgaaaagggtgctggcagggctggaatccctgaggaggatcttcctccagctctgcccagcctccatttggtggtcagtaggggtgggcataagaccctaacctgttccccattcttcccacagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttggtgagaagggagccacctggcctagctgggggatggacaagattatcctgggtgactacctcccaaggctgcttggtctagagggagggggacttatacaatcatctgttttctggagaaagagaagtcctgagggggttgcgtatcctgactaggatggtatcttggcttgtctggccagggagtgaagatatggttggtcagaaagggcaaaatactgaacctgagggaatggtagggggatgaatagaaggactattaggaaagactgggaatgaccagccttcatgggtcagtttgaggggattcccacatatccggacgtgaaccgcctgtggagcattgtggacaaatacaaggtgaccaagttctacacagcacccacagccatccgtctgctcatgaagtttggagatgagcctgtcaccaagtgagacctcttcccagttgctgccctgtgggtatccctcagagctgggtgctggcctttgtacagtctcttcttttccattgtcccaactctctgacctggaatagaggatggggcaagagaaaagcctgggtatgtgtgtcttccagtagtactcagagccttcctctctcccattcccctgccccaggcatagccgggcatccttgcaggtgttaggcacagtgggtgaacccatcaaccctgaggcctggctatggtaccaccgggtggtaggtgcccagcgctgccccatcgtggacaccttctggcaaacagagacagtgagtgaagggtacagaaggctggggcccagggacaatgtgggaagattgactcaaatttctcatctctgacttccccagggtggccacatgttgactccccttcctggtgccacacccatgaaacccggttctgctgtgagtgatgcttccctggctggtcttgggctaggcagggatggtgtcttggggcacttggcctagttagatagtggagaactggactgacatgtgtgaagaatttggggttctggggccccttgggagttgagtcagagttgcctcattcctcttcttgggttctgtctcccgtttgcttctagactttcccattctttggtgtagctcctgcaatcctgaatgagtccggggaagagttggaaggtgaagctgaaggttatctggtgaggccctggcccttgggagtctttaaggagagagggaaagggtctgccaagggtactttgctttagagttaataacctaatctctcctggtagctgcttaggactgaaacttcatggttggaggtttgctcactgagagaccctggaggggaccctcgatactttgcctgcatctcttccttttgggccataagtctcctaagggcgttttaagagttgctcagattcctgatggtacctttttgggtctggaagactaagtcccatcttcttttgacaaagattctacagaaaggaggctttataacatagtagaaaatcacgtaggatctggagtcaccctgcctgggttcgaatcctagctctgcctcttctgtgacctcagataagttatttaacacctctgaatctacattttctaatttgtaaaatagggttaaagtggtgtctctggccgggcacggtggctcacacctgtaatcctagcactttgggaggctgaggtgggcggatcacctgaggccaggagtgcaagaccagcctggccaacatggtgaaaccccgtctttaccaaaaatacaaaaagtaactgggcgtggtggtggacgtctgtaatcccagctacacgggaggctgagacaggagaatcacttgaaccggggaggtggaggttgtattgagccgaaattgtgccattgcacttcatcctgggcaacaagagcaaaattccgtctcagaaaaaaataatgcctttgtctcctatggttgcttgcttgattgagttagataatccacatgaaggggttagcagagaaactaacaattagtacttgataaacattagctgttgtgattattgtattcatacttgcaggagcctcacctgtcccttcaaccccaccccatttcactttcccaagagcaagttagtaacagggacagggcttacatccaggccttctgactcagcctagaattccatccattccatcgatctgctgccaaagaatgttactgattgggcaataattatttacttggtgtgtgggcaccactgttttttaaatgagtgttttcatttgtatcaaactggacctgctttcctcaaggattgcccaaaaggagacacaaatttactaaacacttatcaataatagaacaccgtgctaggcaatttccatatactattaatttaatcctcacaataactttggaagacagaaagtattttctctgatttacagatgaggatcctgaagctcagaggggtaaagttacttctctgaggtcacctagctagtaagtggtagagctgggattccaagccaggatcctctgtctccaaagcctgtacttcattcaggacactttcccccacatttagaaaagctgtaattatcttccagtgagacagcatagcaaatgtgatcactgtcccttcctcactccccaggtgttcaagcagccctggccagggatcatgcgcacagtctatgggaaccacgaacgctttgagacaacctactttaagaagtttcctggatactatgttacaggagatggtgagccttagctatccccctcttgcacctcccactaagacatgtaccttccacttccattttcaggaagagttggtgtgttgctataaaataatacctgagactgggtgatttataaagaaaagaggtttattttggatcatcattcttcaggctgtgcaggaagcatggtgctggcatctgcctatggtgaggcctcaggtagcttccaatcacggcagaaagcaaagggaaagccagtgtttgacatggcaagagaggaagcaagggagagagggaggagataccagcctcttttaaacaaccagatcttacatgaactcatagagttactgcaagtacagcaccaagccattcatgagggatctgtcccccccgccccccccacctccccggccttgaccaaaacacctcccaccaggccccacctctaacactggggatcatatttcaacatgagatttggaagggacaaacatccaaactatatcagttggttaggggtaaagaaaattagagaagaatgtgtcctacatgtcagtatctggtttctacgcagagctacaaagactgtaagggcaggaatgagtatagcaggaggggtctcagaatggtgccatccgaactttgatgtatgaggaaagatggacaatgtatgctcctgtgttgaaagagatggggcatgtggcagtgcatgactattatgtcatgtttgtctttatgtctggagtctgtgtttctccatctatccatctaccaatccattcatccataagatctgagcactgtgatcctgtgcccaggcactgatcatgaataatgtagtcaaaatctcctccctcatggggattctagtaaggggagacagacaaacccaacaaacataaataagcttatcttagatagagataaatgctgttaagaaaaataaacagggtagcatgatagtgtgtgcagggatggctactgtacacaggatcgtcggagaagacttctctgaattgacatttgagcagaggcctgaagggtgagaaggaaacaggcatgggaaaatctagagtaagagtgttttgtgcagagggacacagcttgagatgtctgaagaatggactgaagcctgtgtggctggagcgtagcaagcaaagggaagaatattacatgacgttggagacgtacataatacagggagggtcttgtgggccatggtgaggagtttgaattttattcaaagtacagtgggaaaccttttttttgttgttgttgttgttgttgtttgttttttttttgagacagaatctcactctgtcacccaggctggagtgcggtggcacgacctcagctcactgcaacctccacctcccgggttcaagcaattctcctgcctcagcttctcaagtagctgggattacaggcgggtgccaccatgcctggctaatttttgtatttttagtagagacggggtttcaccatgttggccatgttggtctcgaactcctgatccacccaccttggcctcccaaagtgctgggattacaggcatgagccaccatgcctggccaccttttggggttttaagcaggggagtgctaagaattgatttactgtttagaaaataactttgctggatttatggagaatagagtttaggtgagtatactattggcatggaacaaattatcccaaaagttggcagcttaaaataacaaatattatctcacacagtttctgaggatcaggagtctgtgaacagtttcactgggtagttctcattctgggtctcttgtgagtttcagtcaagctgttggtagggcctgtagtcatctgaaggtttgagtgagcctggaggacctacgttcatgcttactcgcatggttgttagcaggaatcctcagttcctcacctcaccataggactactcaatacatggcagctagcttaccctacagcaaatgatctgagacaatgcaaccgagacaagctaggtgtcttctacaacctaatctcagaagtgacatcctatcacttctgccaaatcctatgatgacacagactaaccctagtacaatgagaaagaggactgcagggctatgaataccaagaggcagagatcagtggtgccctcttggaggctggctactacagtgggcaagagtggaagcaggaagacttgttagaaggctattgcagaaggtgtagcagtttggtaatgtggatcaggtatcctaccgtagggtttttatttattaggttttgcatttcttcccaggctgccagcgggaccaggatggctattactggatcactggcaggattgatgacatgctcaatgtatctggtgagggccaggggccaccttcccatcttattaactctgctcctctgacaacacccagccgaagccttccgcaagagcccaggagtgtcctttggccagaccatgtactaagtgtagcattcagttctgggcccaggttttagaggagtaatgaacactggaatgtgcctagagtaggggaacttggatggtggggtgactgaaagcatgtcatctgaggagtgaatgaagggtcttctccatttggccagaccaggactgccccatgggtacagatggagcatgggctggggcagagcctgggatctctctcatggcacttcctttcccttgacaaggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagagtaaggagcctccctgggcagggactatagggtctgtcttggaggcccagttatcactgcaagttgttggggaggggctagagcaagctgctccccaaaccacaaacagattccagggggccccatgggctgattgccctcttcctgttcagtctccactagtctcccactaggataataataatagccaacatttctagaatactttgtgccaccgctaggctaagtgctttaaatgaattaccccacttaatccctagagtcacctccatgaaacagatcttattgttaccttcatgctaaagatgatgaaactgagactcatggaagttaaatcacttgcccaaggccacactgctagaaaggtggcatttaaactctagcaggctcattctacagcctgagttccataagataaaatgagagagtaaagagacaagtgtgttgagagcaagagaagcagtgaacctgaggctgtctctgtgggcagggacttgaggaggaaacaggtggggaacaaagccatctctactttgatttttgaaaagtctggctaagggtgctgaagaaatgcttgatgatttgttggttacagttagagaaaagattggccccattgccacaccagactacatccagaatgcacctggcttgcctaaaacccgctcaggtatgttcagaggcctccatggattgggatgggctgaggcctggtggtggtggggtgtgcgtggatgaaagcctttggcagggctagggtgggtcagtgctttcaccaagtaactagaggtctgtggttccccagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaagaagtggtgacttgttttcttaggtatctgtgccctgaggctgtatattcattagtggctctgatttgtgtggcagatgggaagggaggggtatttcctaggactatccccaatatcttccttctagaacttttggtttgggcagagcgaaggaggcttcactgacagggcctttgacaagcccctgagctaagcaggaaagtgactgaagccagttcacaactgttatgtatgtcccatcttggttgccttccctcctgggctcctgccagggactctcattcctccctgtgatccagtaagagcattagtgggtggctaaggattgaaacttcagggttccacctgtagagactggtctagggggaccctgattacagaccagtcacttccctgctctaatacatcttaagtgggctaacgtagattacagctcccgcctcccctctatgcacgaagtaaggaatcatcactgaatcagcaatgcagttttatttaaggcagaattagggaaaggctatgcccctccactccccctcctcctaccactcagtcctatcccaagtcaggcactggaacctgctgaaaaggctgatgaggggctgacaggagtggggcagggttcatggacctttacctcagagcagcttaccctgagctatacccacatctcaaggatttgggggcgtctagatctcatctaagggagacacaacttttctggtcctcagatggaaagctgggggaaggtaccagtatttacccttccataaaaactttggaggtctttaggaggatacccctcaggagggctaggagaggaatgacaaatacagaggatagaaggtcccgtggcctggttgtgccctcacacagggtatgggttgtccaggactgccactcccgctgccacaccaccatctgcatgctcgatggctttggttcgaagtagatgccccacgtgcttgttcatcacgagtgtcttttcctgcctatagaaatggaggcaggggacacacatcacctggactcagccccaaacccaggaccttccctggacccagctgagcagtacctgggtaactgtctataccaagaaagtgctaggattttagagtctctatgcctctctggagtctccttctagtcctaggttgtcaaaccatgtgttctgagtcctcttggtgctatttggagtttccttcacggttgcaaaggacttctcatcagggcttcatctgataccctggtaaggtgggcaggtcttgggtccttggcctcatttaatagataaagaaacaggtaataaagctagtgattggcagagctggcaccgaagcccaggattcctgactctttccagtgttcccctctaggctggctcacttggctggcactcttgcaagcaggtagtggaaagagcttctcctgattggctcacctgacatagaccccaaagatgcccagctctgaaatgcactggaccactcgggcagggctgccaggccgtagcaggcaattctcaaaaggctcaggttcgatcttctccatgaggatgtaggaggccctctcctcactgtccttcagctgtttcagggcctgtaccatttcctccccatataggttgttacctgcaatgaaactggccagtcaccctggaccctctgcctacctcctccatcccatgccctcacttttggggccacatgggcaagtcagcagcctcagttcctggcacccgctcagtgaagccagggcatatctggcttctcaggagggaagctcactttgacaggagagcccttactcatgcagtgaacacatcttccactacactgttctgccctggttctcctcctacctacagctgttccttctcaagctccattgctggctccttctcttaaatgctggggtcccaggggaattggtcctccacgcttgctctctcccccatgtacattttcccaaggagatctctcctattcctgagtctccatctataccctaaaaattgttaacttccggccgggcatggtggctcacgcctgtaatcccagcactttgggaggccgaggcaggcagatcatgaggtcaagagattgagaccatcctggccaatatgatgaaaccccatctctactaaaaatacaaaaattagctgggtgtggtggcgcacacctgtagtcccagctactcaggaggctgaggcaggagaatcgcttgaacctgggaggcagtggttgcagtgagccaagatcatgccactgcactccagcctggtgacagagcgagaatccgtctcaaaaaaaaaaaaaaaattgttaacttccaaatatttaatgcaggctccctgcttagacatcatatgactggcccccaaacaaactcaacttgtccaagcagaacttattacttctgcctgaacctgcccctcctggaccttcctactcccaatcaggcaaaaggtacccctgagtcatatttaactcctcccttccactaccctctcactatctaggacatgtctctccagttggccccatagtcatagccctagcccaggcctctacgttgctcttctgaacaactgtatcagcctcttccacggtctttctgcttccagtgtctcccctcattccaggacatcttctacaatgcagaaactgtaagttttgcaagttcccaccactgctaaccacttgagtcctggatcaatgtgtcccttcctggcttaaaactccctaatggcttcccactgcccttaagataaaatccaatttctcagtatatattcaaggccctttataatcaggatgcaaaccatttttccagcctaaatccctgtcccctcccagctccccctccagcctcaccagtttctcattaacctccaaacatctcacactttcatggcccggtgccttggcttgaggttgtcccttttgtatggaacactcttcctcctttccacctgggaaattcctacccacctcttaagacaaagattaaaaaaatcctctcctctggagaggcagacatgacccctgacctcaaggagtttcaaactagaaaggaaaacagacatgtattctctccagtctcctaatatgaccctactctacttcccaacaatctacccacaggcacctcaggtaaaacttgtccaaacccttcaatgctggttaatcagattcccctgtgctcccggacttggtcacagggtcttaggggacactgtccaacatgtggcctgtgtcagttccaatagtttcccccatgcccgggactgtgcccagagtaagtgccaatgagcactggccacagcctgctagtccctctcattgaggagccctgcaaagggagatccacctacctccaccctctctctggggctttagcacaaaccggctaggggcagcaagggcctcggcgatggcctggtccccttcttcaccctggcaggaggcagaaagcagttatcaaaagtttaaaggctaaagaggcaagaagcttaggtccagctggttatgcagagcagcatcagaggaagagcaggagggagaacagccacaaattccttcaggcaggatgctactatctggatgacactcccaacaaaccccctgcagcagccgatgcaatgagaacaggcctttctttagcaacagctcagggctctgcagcaggcagcctgatacacttctcaattcttgccacctgccttagtcccttccctctggttgccatcctcatctctacctttgctgagggagcttacaatggattccagcccccatccttccattatgaggctgcccttctgctcagagttctaggggttctccagagcatcaccaaccttgccagctccaccttccccttgtcacaatgccagctccaccctccccaacacattgggctgtaggtctctgccacctaggaggcctgtggtaggagaaacaggctgcccacgtaccacatccagtgagtagaggccagcaaaggtggcgcggaggcgggccacagcctcaggctggccagggagcaacatctccagcatgcccggcctgcttagctcctgctgcaccttcttagtcccagccagctgggtggcaatgtctgggcacttggcagcatgtgacctctccagcagtagacgtgcttcccaattctgcagagggaagaagacaaaaggaattcgactttattttacttcagctgacgtttactgaacatccatccattaggtgccaggtatcatgatttgtatcttcaccctcattatcacccaggatcattctaacatccttgtgagccaggtgtgatatgttgtagttatgtatcattgtgccagactgtgagcccctgcaaaggcaagaatcccccaatctgtgggaaacaatagaaggtgtaagggtagaacatttgtctacgtgctcagcttcccactgtgttccatactccctaccatggccttcaagatccttcaggagctggctcctgtctactttttcaaccttgtaccatccctgactcctagtctctgccattctactcacacaggcctgtcattcctcaaatcacaaagctctttccctcctcagggcctgcactgcttttccctcaacctgaaacccccttcctttcggcttttcccatgcatagctggatccttaccatccttacatctcagctcaatgtcaccttttcagagaaggcttccctgtccactctatttaatgtggatttcccataattctctttttacccagttgtttcattgaaagcagttacctgagactaaaacacacacatgcacacatacacgcacacgcacacaaacatacacacacaaatcccaatttttttttcctatttttgtttactttttttttcttttgagacgtgggtcttgctctgtcacccagactggagtgcaacagcgcaatcttggctcactgcaacttctacctcctgggctcaagtgatcctccctcctcagcctcccaagtagctgggactacaggtgcacgccaccacacccagctaatttttgtattatttgtagagatggggttttgccatgttgcccaggctggtcttgaactcctgagctcatgcaatccacctacctaggcctcccaaagtgctgggattacaggtacgagccacagtaaatggccatatttttgtttactttctgatgcccatttctctgaccagactgtgagctccatagcacagggctcttatcattttcctcattttctgttgtatctccagtgtctaacacagttcctggcactttgtagttgctcaataaatatttgttgttgttgctgaataagttgaaatttgagtggggttctgaaggacaggtagagcctgacaagtgagactcaatagggaagggatactcaggctaagagaataatatgaacacaggtctcaagtggatgatcacaggatgaatggtttattaccacaagagctgagggtataaaaggcaaggaaacagcaggggatcatgcctcccaactctggttcccattctcatgcaatggggagacagtctgtccttggctccagaccactgcaaactgcacacagcaggatcaggtctctcctgtgacccccacccaatgctgtccttcctttgatactactggtccacctgtagcaccttgacctgatcttcatcaataaccccaggaacccaactactagtctggcattccacgcagaatcacacgtgaccagaacatcagaaataaacccagagaaataccccattatggtagaagcaggaaagcaaaaccaaagataagcaaggacttgcccagggtcatctagtaagtcactaagccttctagatctctctccatgtctaaacctgctctgagctgctcagttccctaaaaatgtctacctcttggccaggtgtggtggctaacacctgtaatcccagcactttgggaggccaaggtgggtggatcgtaaggtcaggagttcgagaccagcctggccaacatggtgaaaccctgtctctattaaaaatacaaaaattagctgggtgtggtggtgggtgcctgtaatcccagctactcaggaggccgaggcaggagaatcgcttgaaactggaagtcaaaggttgcagtgagccgagatcgcaccactgtactccagcctggtcaacaagagcaaaactctgtctcaaaaaaaaaaaaaagtctacctctttaaacactactttccttccttgttatctcaaactcttctaagttttctttgtcgtgttttgaaatctagacccatttcttttttttttttttgagacagagtctcgctctgtcagccaggctggagtgcagtggcatgatctcaacttactgcaacctctgcctcccgggctcaagcaattctcctgcctcagcgtcctgagtagctgggattacaggggtatgccaccacgcccggctaatttttgtatttttagtagagacggggtttcaccatgttggccaggctggtcttgaactcctgacctcaggtaatccacctgccttggcctcccaaagtgctgggattataggcgtgaaccaccgtgcccggcctagacctatttttctaatagacagtttatctctcctgtagtcagcaagttgccaccactgctaaccacctatctaaagaaaaggatgttctatcgagataccacctctatagagcctcctcatgtggagctcaaccctcggggggagtcctagatgaattacagacctagaaggagccccctcagttttctagtgtagctccccccgctcatagaaacagacctagaaagggtcaggaacttgcccatcatcacacagaggcagtcaagctcatgacctccagctcactgcccatggtatttctaaacttatttcctcctttatcatctcccagctgagagcagagcttcttagcctctccatgatgtggatgttaggagcagaggagaagaatgggaataccatcggcctgaaagtcagaaaacctgggaacttcctgtagggccttagagaagcctctccatctctctaaacgttagtttctccatctgtataatggggataattatatgcctcaccgagtggttgtgagggttaaatgaaataatggatgtggaaactaatgaaactacatggtaggatagcaaaatgaggtgatataactgtcattaacatgaatgaggagatgataaaactttctgattcagataaaggaaaggtaagagttggcaggaaaaaaaatggtcagcagtatgctggaactggcttatatcaaccagtgagagctgattgttgttaaacatttgccagcacatctctggaaacagtgtaaatggctgaagctctgtggattcctgaggattcaaattctagaagactgtgtagagtgataggtagcaaaaggcttgagggaggataggaggttctagcagcaagctccctgagaaagaagtgaagtgaggactcggaaaacccaggttgttataagcctgaattgggtctctgtggagctcttgtgggtcccaggaggcaaagaatggtctcacagaaaataccaacctgtagactgtactgacgaggcatgtagccatcccggaagtaaaccacagcaatttcctggccatccctggaacacaggatggagaaggctgctgtgttaaattataactgatttgttcagtggttcaatctatttcagggtgcatcaagatgaatttggctttttcaaaattcagcccacagtgggagcctggtcaggggttcactggaaccagtgaaagtagatatccacactaccagggcttccactgaaaacagggaggtgtgccatacagaatactttagaatatgccagatttagagtcattctaagaaggccagaaggaacaagaaggtcactagaatcaaatttggtaaatgcatacaaatgttggctcgaaattaccgagcagcagaatcatactgccatgtgtagtaaaacacactttatatttccactgcttaaagcagctgaaaccagaatgaaaaaatttttaatggcaggggtgaaggtgaaaacgcaaacatgtaaaatgatgagtctgattaagacacaggctttttaaatgtcttttccttttctttgacctatttgatattgtctagtttatctgaaaagtaaattaactactttgtttagttatgataaaagcacattttgaaaaacagtgagtggtattgtgaaattccatggacagttttaattttaacaatcacaaaggtctaggtctaaatatatgtgctgcaatgctacccaaatatgtagcaccaaatctacctggtggtggcccctagagaaaaggataaggcttggcttggaacacaaatccaggctcgagctcagacagtggcatccagaccaatcacagcatgagccagctgctcctcttcctccctgactgcccagctcagcttctcaggcctgacctcaccttactaggagaggcaagaaaacttttgggaacttagggcatatgaaaactaagatgatctctaaggagaccctgatccagaatgtcaacagctctgatagaagcacagcgtggctggctttctccaaaatttcctgggaggatgagatatttcaggaattatgagagaaggaagcaagccatcacatctcccagaagaaagaatcattttggggaagagggtggcaggatgagtttcataaaccagccttccactggattcttgggaatgcttacacaaacagccttcggtcttggtccagagaccccttttcagagatatcttcaaatgttcgtcggatcacatggatgttcctgggaaaaatgggcaagagccagagggaatggatgctatgttctgagtgccccacccctaatcctggagccacacctagaagtcccccttcctttacttacctggccagtagctcattctctatggcacgctggtcaaatatgtttctttccttctcttgagcaatcagtagcaccagagcactggggaaagagcacaggtggcccgaggctactatagaacttgttcttcttttgtttctcccctcaacccccataccgccccacctcctggaataagaataagaacaccgcttccctgaaagaacagatgttccctctctcaggaaccttgagattacctcaggcatagacacctgatgctatcacatatgatttcctgaaaatagaaaacttcaaaaatgaagatgcctctgacccttctccagtgggcagatgaaatattgtaatgatgtcatgggttgatgaatttctgtgcaaattaaaatttagatttaaaaccatctcaaaaacccaagaggactttttcttagaacttaacataattctaaaatctttctggaagaataaacaagtgggagtattgaggaacattttgtaaaagaacaatgcagggggtccggggctaatggctctattactagattgtaaaggatacaataaaggaatgtggttcttacacaagatggaaccctacagaaacccacagggccaactacaaacaacgacattatctcctgggccctcccaagattcctataatgtacacagggccacatttgatctcatagtattaatgagatcactagggcttatgtggcttcttcctctctgattattcatgtatttcttaaagaggcaggggcttgagggctcagggaaaagcttatgccagggaactatctgtttggctgccagctaacatatttccgttgtcaaagataggtccagtcccctaagagattcctagggctaatgctcagcagtaccaaactgcattttttttcttttacattttattttatttatttttttgagacggagtctccccctgttgcccaggctggagtgcagtggcacaatctaggctcactgcaacctccaccccctgggttccagcgattctcctgcttcagcctcccgggtagctgggatttcaggtgtgcaccacccccgccggctaatttttgtagtttgagtagagatggggtttcaccatgttggccaggctgggctcgaactcctgacctcaggtgatctgcccgcctcggcctcccaaagtgttagcattacaggtgtgagccactgcgctcagcctccaaactccatttttgctgtgactgtactgctttgtgtctgtggcttcttcctgagacccatggaaccctaggctttggcttaggattctaagtgtgtattccctgacctcctctgcttagcctctcttgtctatctctgcttctcctgaccttggctgaacctcttagtctaaactctgtttgcctgactcctttctgcttagccaaaatataggtcttagtaagtcccctctcctggtttgcctgaaatctcatgaggtcagatgtgatgttaagctgagtcttggctttgagttgggtgcctgagagacaaactaaaagtggtgctctcacaagtcatcttgccctgagagagtcctaagggccaatggctttgctcttcactttgcagcctaaactgtcccgctcatgggtgagggtgtgtgtgggagggaggcagttggcccaggctggcccacctccaaaaagaggcggaggaggaaggctggcagctggaggttaaagaggaactgcacgccccagctaattaagtcagcctgccaactgctaaacaatcagagctgggctcagaaaacatatttgacctctcctgccttcagttctgagcagttctcagcagtctgtttcctagtaggaaagttgtcagctaaggacgcatgcgggctgggggtgaggacccctgagtcgtaggtagtccaggctctgccagtgacttgtagtgtgtcttggtaattgacttgggtaaggcaatttcgttccttgggccctggttttcccatctataaaataagagtgttatggctgggcatggtagctcacgcctatagtcccagcactttaagaggccgaggcgggcggattgcctgaggtcgggagtttgagaccagcctgaccaacatggagaaaccccgtttctactaaaaatacaaaattagccaggcgtggtggtgggcacctgtaatcccagttacttgggaggctaaggcaggaaaatcccttgaacctggaaggtggaggatgtagtgagccgagatcgtgccattgcactccagcctgggcaacaaaaacgaaactctgtctcaaaaaaaaagaaaaaaattggtgttaaaaagatcacagttcccaaacttttatcaccagtagtccccttttcttattctactcattctaaccacaggccctatgctttgagagtttgtctaaattgaaattgtaagtcattttgcaggcttccatttttaagaaattttaaaaatcatgagataattgacgaaaattaatctgctctaccaatgcagtttttcagtcaatactgtggaaccatatctcttaaaggcagaatagggaagtagagagaacataggctttagaggcagatgaattctatacttaccggttgtgtaactttgggcaagttattcaaactctcttagcctcagtttgctgttgtatgaattaaaactaatacttgtcaaatgatagctattattattattatttgggtttgttttttgttttttttttttttgagatggagtctcgctctgtcgcccaggctggagtgcagtggggtgatcttggccactgcaacttccacctcccgggttcaagtgattctcctgcctcagcatcccaagtagctgggactacaggtgcctgccaccatgcctggctaatttttgtattttttagtagagacaaggtttcaccatgttggccaggctggccttgaactcctgacctctgatgatccacccgcctcggtctcccaaagtgctgggattagaggtgtgagccactgcacccggcctattattattattgaaagtaccacataatgatccacacagatttttaaaaacatttttcagatccatgatctcatttaattctcactaacacccctttaggtattattattactcctattttacaaatgaggaaactgaagctcagagaagaactaacttgccaaggtcatgtgctatgtcagcagaagaacctatctcactctcacaatgggggaagccagttctggctcaggtgccacataactcctacctaccagtgcctaattttggacacacaagtattttctgtccacgttactgacaggctggcaggcaaaaccctctgcagcatttgtctgtcagcagttccccagctgacccatcccctggcttcactctcttaaaatacaacctagccaatatacttgaaagaatatttgtctgatgacttctaaatgcttacagtctgaggtttctttgggcttagtgaggcttagcaaggacagagaggctcccttggaggtaagagcatgattaagagtggaggttttagagggaggtagactttgggatctgccaccaactcatcacttagccttaacaattcacttcgtttctcagaacctcagtttcctcatctgtaaaatgagggagttgaacagtattgacctcagagagcttattatgagaattcaatgagatcctgtatgtacagagcttagcacaaggtgtagcactagtaagtgtacattaaggactattaatgctatattaacattgcaataactgttagtatagcggcccctcgatgatctgaaaatcacttacctaacatcttcacttgagaaataggaagaaagcaaaaaatgcctctaagcagttaaaaaggataccataaaatttcgtagtcaaagcttatgcatttactcatccaagaggccctcacactcttcagacccaatcataacaatctggatcatttgttttcccaaaccacagcaaatcagaagggaggcatgggcatggggggtggaggattccaaattcaagcataccaacagcagtcaaaagtaagagctgagaattgggaaacagacaagaaaactatgaagaaaatgaatgagaggccgggtgcagtggctcatgcctgtaatcccagcactttgggaggccaaggtgggcggatcacgaggtcaggagttcgagaccagcatgaccaacatggtgaaaccccgtctctactaaaaatacaaaaattagccaggtgtggcagcatgcgcctgaaatcccagctactcaggaggctgaggcagaagaattgcttgaacccgggaggtggaggttgaagtaagccaagattgtaccactgcactccagcctgggtgagagagtgagactctgtctcaaaaaaaaaaaaaaaaggaaatgactaagaacttaaagcctagcagtcagagctattagcgcaggcaaacagccttgcgtgcctctctaaccctaggtagcactactgtattacagcaagctgcaattgttgacagtcataatgatgacctccactcaataagaaaaagttaaatcatagtcagcatctgttatttaagaaggaaaccttaaaataattttggcatgtaaaggtataagtttctattcctagaaaaatccccttattctctaatgatggctggcaagaaaagaagttgctaaacccatgaatgctgaaactaaagcaggatcctcctgctaccttttcacacccttacttgggtgagccgtagagctcccaggctttggcaattcccagggccagtcccttgctgggattattagagaggatcttgccagcttctttggtcttactcaggacactgagaacatgtctgttggaagagagatggctgttcagtaattggatggacctggaagacccctctgcccatgacctcatatatacagcaacatgactctgagaatcagctgagcactaaaaagcatcctcccatcacattcctgtaagatccacttcaggttggaatatgctgggctgccctaaccttggcccctggtgtatatgcctggaggagacctgagagcctctgtccccaccccaacctaccctagtgtcccagtgagctggagccccttactctgggcctccaggtgctgtctggaatcctgctgcagaccatctaaaatcattgcaacctggagcatcactgctggctagaaatggatgctaccaggcccagcccccagacagaagtccctgcattcctctctctggggctctcaagatattgttccctctgcctgtacaatggagggacaggactagatgagctatgaggtcctttttctccctgacataccaaggatctcattacaagtggaaactgctgtcggggtggccaggggcaacatgtgacccggggcccaggaaagcacaatcatagctggagttccctggcctagccagtgactgtacacccatcagcatgtcaccccacaggtatgccgggggctgcccaggggacccaccggtgcacagctggggtccgggaggccaggcccccaaagctggcagagatggtgttgatttcgatctgtttcagggctggggagccatctgcgctgcgctggaacatgtagtctgagcgattcaggcccaggaacacagtctgtggggaaaactgaaggctgacagtacctgcccagggactgactctgaggacctagccacagagcacacaggtaccatgaactctacacagagattagaggtaccagcaaacactcccaagcccagtggaatcattcttctggtcatcctagaattggtcactgggataaacccagtgaggaccagtgagaggcagattcccatgagctgagggcctggaccaaattcttcaagcaaaacagaaaacaaacagagatgggagggacaggttacagactggagtagggctgggaatggttacctgggcaatgccctcttttaggacttgcttgtggatgtcaaagagacgagcggtaaagtcatcctgtttgatggtgctggaggaagaaacagagaacattttgcaggcttaattggacctaaaatttcaaggagtcccatcctcagtcattgactcctgaatcctctctgagtctactggccaaaacttgaatgtccgccccaatgtggtagagaacagtggctaagaatccaactctagacctgggttcaaatcctagctctaccactcactagtaggcaacctcagggaatcatttcacctctctgtgtctcagtttgctgatctttaaaatggagaatataattatatttatatcatagagttgtggtaaaaagccaataagatattacattcaaagaattgaacatactgcaccgaagaagagctagaaaatgacatgatgtatctattctacttgaatagctctgatggttggcaagccttctggttgacctaatactaactctccatagcttttcctaccctctgcgacctcccagggtgagccttctcctcctcctccacagcagcccttggagattagaagacagcagttatgccctgtgcaccaataagatttttctgacccaagctaaatatcctgggttttttttgtttgtttgtttcttcttcaactagtcctcatatgatgtgatttcctcagggaagccttccctatctgagtcagatccccctactatgtgttctcatagaactaagaaccactcctttacagcactgactgcagttgcaattttacattttctttgtgtgatgattagtgtcatctctcctgtttgactataaacctcatgaaggtaatggctgtgtctatgcaggctcatcgtcacagctcagtgtactgccatgacatgtgacatgtgttaggggcctatccagtatggttttctgaagtctcaacaagagccacagtaagaaggaatccacaggtgattaacatcacacttactgccctttgagattcagggtggattctgcacacctgctcaagcctgaatcaccttgttacagaaacgtcacagcagaccagtggggggaagccaagtagcccaggcctgccctgaagttcctctgctcctcagccagctctctcccaagggtgagctctctcatgccagcccttggttaggaggagagtcccagctgggcttcagcctccaaggaagttgagacacactttcctttttctgaagaggtgctccccttcatgttttgtagggggctcttctcccttaggaactagggtttatatgtgtatgagaggagagaggaacagagaaggcaggggttgcaaagatgagctgcaagtctccttcataattgcatcattagggttataagccaggctgctcatgtttcccacaatccaggattgcaggtacaaagctgggcccattccaagaaacagctcaggggcaaggtggtgggcagattcatacattcatgactcattgggtttttggctacaagtcaatggtttccaagcttcttaccattatgaccccttctcatattcacccacacatttttaaaagattttgtctccaacaaaagtctaatttctgttgaaaaattaatcaaagacatgcaattacaggttggatatcccttatccgaaatgcttgggaccagaagtctttcggattttggaagatttgcatatacgtaatgagacatcttggggatgggactcaagtctaaacacaaaattcatttgtttcatatacaccttatactcatagcctgaagattattttatacaatattttaattaattttgtgcatgaaacaaacttttgactgtgttttgactgcacctgtcacatgacatcaggcgtggcgttttccactggtagagtcatgtggtgttcaacaagttttgaattttggagcatttcagcttttggatttttggattagggatgctcaacctgtacagtatatacacatctagcatgtatatgtaaatacataatatttctagatatttaattctacaatgaatatatatacatatatatatgtattattatttctttttttttgagatggagtctcgctctgtcgcccaggctggagtacagtgtcgtgatcttggcttactgcagcctctgcctcctgggttcaagcgattctcctgcctcagcctcccaagtagctgggattataggcacccgccaccacacccagctaatttttttatatttttagtagagacggggtttcaccatgttggccaggctggtctcaaactcctgaccttaagtgatccacccacctcggcctcccaaagtgctgggattacaggcctgagccaccgcgcccagcctatatatatttaattctaaaataaataaagaaattttaagaaattgccccagaatctgaagaaaaaaaaaaaaagatcaagggaaagagacagagaagggcggatgggctgaaccatttcagaggttgcttcctcatgccctgagtgtggcccagtctgtaccccatcccatccaaagatgagaggcctgaggtgacaagaaagtgtcgctgcttaggagaagtagaaaatctgactttaacccaataaccttccctacctctgttttcctccaaaaccaggctgacttcccctaattccaaatggaaatatcagtcttcaaagtagggtgtcacggattacagaatgtcaacaataaagggatcttggatttaagccagtctcttcatttttcagatgaagaaaccttaggcccagagaaggaaagggagtggcttgaggccatataaataactggtcgagccaggattagaagccagctttcctgactcctatgactttttgttctttggaggtacctttcctctatcccaccaagtcagctgacacagtaacacctcacggctctgcaatcttccagttccttggctctggcagctcctggccccccaatgcttcactgtcccctacctggaaagagtttgctccaggaaggcagcgttctggctgacagcatccactagcaggttgaagtccatctgcacagcataggcttgctccagcagggcactggggaccagtgaggggaagagcgtgaatggggcatagctcaccacctgtgatcaagaagagagaatgggacaggggtagggcacctgtgaacgggttgtcttcctgcaaatggaatcccatggaaagtctggcctatatttactgaggacacaccaactgtagattagtggttaccttgggagagtggaagggggagagtggaacccagagagcttccagattctgtgatagtttatctctacgtattgaagagagagaagcaaaaaagcaaaatgcaaataacaaaaagaaacccacaagttattgagcacttactatgtgcaaggtactattttaaatactttacatagattcatcattcagccctgtgaggaagatactattattatccacacttaacagagacgggacctgagaaagagaggttaacagatccaaaattatattcagctaggaactggtgctgggatttgaaccagaacagttaacagatccaaaattatattcagctagtaacggggtgctgggatttgaaccaggatggttactaaacacaacacacacatacatacatggaagcctgctccttgctggttgatgttcaagcccaggcccttccatgcatcaggagctcacactccagtttccttgccttttgattttgatttggttactgggtaggacaagtgaactctggttcccttagtagaagccaggagtgttttttccaccaatgttagtgatggtgactcaggttaacaggcctagagttcagctgcattccgcattctttggactttatcatagacgagaaacccaaataccatcaaggacactgattctagaagggaaaagtgcattctgagatccctgccaacaactgaactagaacttgggtaagagatgaaaagaaaatcttgtgacttgtattataaagcattcctgagtttaacctttgagttaatatcagtttgtcattatggtggtataagtttacggtgttagaacttggtatttagatatttatttttaaagtactatttttttttttgaggtagagtctcactctgttgcccaggctggagtgcagtggtacaatctcggctcactgcaacctccatctcctgggttcaagcaattctcctgcctcagcctcccaagtagctgagactacaggtgtgtgccaccacacccaggtaatttttgtatttttagtagagatggggtttcactgtgttgtccaggctggtctcaaacacctggcctcaagtgatctgcctgcctcagcctcccaaagtgttgggattacaggcatgagccaccatgcccagccaaaatattattatttttttaacaggtaatacaaatacatgatacaaaattcaaaagagacataagaatatatagtgagaagtatgtctcactctcattccagtctcctggggaaaagactgggccccagccacccagttctcctccccagaggcaaatgacagactagtgtctcacacatccttccagtcatctttgtattgatatatatgtatacacatatattttctctttttttcacccccatagcaaactatactacattgtgctttttaaatatttccttatatgttcaaatagagcattttcattatttttaattgctgtatattattctactcttaggatataccataatttattgaatctagtatataggtggtttctttattttcctattaccattaatgtttcaatgggtatcctagaatatacattctagatattttcatatatgagaaagtccatacattctaaatttctaaaagtaaaaatatcaagtaattcaggtaaatctattttaaattttggtagataatttctaaattacccttctcagcatcttttttttttttttttggagtggggtcttactatgttgcccagactggaatacagtggctattcataggtgccatcatagtgcactatagcctcaaattcctgggctcaagcaatcctcctgtctcagcctccccagtagctgagactgcaggtgtgtaccactgccctggcctcagcatctaagataaaactgaggaaggctatttgtgagaataaggtttattcagtctgaagcctttatgagttagaatgggaatgactgcagattacataaggggtgacctaataccctgagtagctatgtgatgactacaggagcatttccttggcttgaacacatagagctctgctgcccccaacaagtctcatcttggcctcaaaaactcagagtttttctgctaagacatccctctgcctctgtcccagggctcattatgccctcctgaatttaggatcaatagtttatagctgttctctgctatctacaggctaaaggctgaaacacacagtcttctcacttttgatagagacattaacataaaatgacattactggccgggcacggtggctcatgcctgtaatcccagcactttgggaggccgaggcgggcagatcacaagatcaagagatcgagaccatcctggccaacatggtgaaaccccatctctactaaaaatacaaaaattagctgggcgtggtggcacacacccgtagtcccagctgctctggaggctgaggcaggagaatcgcttgaacccaggaggcagaggttgcagtgagctgagatcgtgccactgcactccagcctggcgacagagtgagactctgtctcaaaaaaaaaaaaagaaacatttttctactatttaaaaaaacctatagcacgtgcatgacaaaattctgctttgtagccaggaagcaacagggagtgataggaattgtggcaaaaagaagtacttgcatcttctctaaagggggcagccagaactctgctctagccaattgttgccatgcaggaaagtaggccagagttgccagatgatataatttttcaagacaagttgggttgctagattttttgttttaatttcatgatttttttttttaaatgttggctctgactttttaaaaatactctggtgaaaacaactgttaacaatgcttgcccctggtcagggaaacagtggctggaggaaggggacttactctgtactgaatacccttttgaattttgcgccctgttcaaatgtatttgaacgtattacttattgtaaaaaacaaattaactccccaaacactgcaggagccaaatactcagcctagatatggctagtttgcagctctgatctacaggataaagttcatactcctcctccacccagtagctaaggccccgcggctgtctgacgctggcctgccttctttcccactatatccacttatgcgccctgcatttcagctgcattctcttgaacatttttttttttttttgccttttcctacttttgggtccttgctatgctgttccttttccctatttgtcttttaaggtctagttcaaataccaccccccatctcaatcatctaatcataatgaactactctttcttccagctgtcctatatagtatcttgggagaggaaaaaaagcatggatgttcagagcatggactcaggagccaaattccttgggttcacatcctggctctgccaattattttaccatttaaataacctcaggtaggttacttagcctctctgggcttcggtttccttatctctgttgtggtgaggagtcagtgattccaaagtgtttagaataatgcctggcacatactaaatactcaataaatgatagttaactttgtgtagcagactgcctgtgtttcctcatagagctgatgttatttaattttgttttgtggtatgttctctaactagaccaggagccccagaggctagggctctggctgactcacctctctgtcctcagtgcctacaatggcccggcatagagcaggcatttggtaaagatttggagtaaaatcattctctctctctctctctcacacacacacacacacacacatacacacacacgtacactttctgactttttttctggattagaaatctcattgtggattacgccttttctaggctccataacctcccagaaagaccaagtgttggatcttcacatggtacctattgattaacagaagaaacaaaagcgtggaagagaaaatgcttcattttagattcatacaagtaattcacaaaatctaggttcacagcccaagcaattctattccataccatcagcctgccttaggtgacagacattgtcatttacttgggccttagcaaacaattactgagtgtggactccatcaggcctgtgtaggttctgggcacacagagacaaaaaagaatgggtctggctaaaaaaagaagagatgttggcagctctttagtcaccaatatggtcttaaggtgtactgttaagttaaagaaaaaaaagtgggcaaaaggaggctgggcacggtggttcacacctgtaatcccagcaattttggggggcagaggccagtggatcacttgaagtcaggagtttgagaccagcctggacaacatggtgaaaccctgtccctaccaaaaaaaaaaaaaaaattagccaggcgtagtggcacatgcctgtagtcccagctacttgggaggctgaggtgggagaattgcttgaacccaggaggcggaggttgcagtgagccaagattgtgccactacactccagcctgggcaacagagcgaggccccaaggaatatatttacttgttattagttacttgttatgaataagccatctgaaaggatcaacaagaaaccaaaacacaagctgcattagggtaaactcttgtaccatttgaatttgaaccatgaaaatgtcttacctagtcaccaaattaaaaaagattttatttttttatttttttttcttccctaaggatgaggttttaaaaaggtgtggtttggactcagcagttctacttttacgtattgaacctggagaaacactcacataggtgccccaacagacatatgcatggatgttccctataatgctatttatggtcataaaataatgagaaatcacctaaatagacatgagtagagggaagctaaactgtgatacacccacatctggaatactatgcctcagaatgaagatgaccctaatagaaggcattagaaagttctaagacagacaaataaaaaaccaaaaacatatcatagaataatatatatgatacaatttgttttttaaaaaagacgtatttctatatatacctatctatgtatataaatgcacagagaaaggcttgaaagcatatatcacaaaccagttacagagaaggtagagtgattatggggttttcagtaatagctcactgggcaaagtgcttcacatgaatcatcctgtaattctcttaccaaaccagtgaggtaggtcctattattatcccatttttacacctgaagaaactgcagctgagagcggttaagtaatttgcctaagtcacacttcaaaccccatatttaaatttgattactccaggacactgcctttttattttctacttctagagatcaattttagttactggaaaaaataaggcaaaagagatatggtccctgatgcaaaggagtgaccctcagcctggccggggccagacagtgggccatggtgaatgctgtggggaggagctaggggcttacctccgaggaagtgggctcctgtgaggtcctcagcaatactccctcagccagggcccggtccacggcctgccgtgccagctcctctagctgctgtttatcctgcaagaggctcccccagttggtggccatcccaacacctgcaaaagatggagagaagagagttggtaacagatggcctgaagcccagcaaccaccgaaactggctggcggccacccccaacacagcaggaccctgacctctgttggaagggaacagcgtggtatacaggagtgaacactggctggttctagctcttaacaacttccatgtgcacaaaatagaaagcttgacaaagcatttccattgccactctctcttttgattcccaacacaatggcattattctcacagtaaggaagcagaggcttggagaggtgaaatgacttgcccgaggtgatgactggtatagcctggacttgaacccatgtctctggactcccagcctaaaggctcttcattggagaaagaagcactaatatcagatgtgactggggcaagttccttcccttcccagagctacagattccctaactgtgaaacaagaagaatcggatagatcagtttccaaacctggctgaacattctggggagctgggaaagaatacagattcctgggccccatcccagagactctgatgcaagaggcctgatgggaaggaggggttgaggctttgtatttttttttttttgatatggagtctcactcagtcgcctaggctggagttcagtggctcgatcttggctcactgcaacctccgcctcctgggttcaagtaattctcccgcctcagcctccctgagtagctgggattacaggcacacaccaccacgcctggctaattttttgtattttagtagagacggggtttcaccgtgttagccaggatgatcttgatcttctgaccttgtgatccacacgcctcgacctcccaaagtactgggattacaggcgtgagccatcacacccagccgaggctttgtatttttaacaagttttcctgggataggagtcactgcagtacattattaattcccttcaagctccaacaactcatgtcagcagatctcaaataaattacatgggaagggggagggagctctttgtggaataccatgaaatgcgaataaggtgaactcctcccttatacaaaccagaaggaatcttagtagcaggaaatgactacattccatatatggacatttatcatcaaagcaccaaaagacagaaaatatttttgagaaatcacattagcaagatggaaattgctgaaacccaagtgtccaatgtaataggagaagttgtctgattggttgcccagagacatacagaggtgtacaaactcacaccctgatactcattcatttttcagcaggcctcaggagtttaagatctgggtaaaaatctggaaacacagtcactaattttgttctgccctgttgccatttaacagaacatggttgcccaactcagtggtccccaggaagggagttagagaataataggaaacctccatcacattcagctctgtccccctgtccccatgacagagccagtgccaggccaattatgaaagtctgccagcctcagcacaatgctttgaaagaatgcgcatgtgatctcaagagggtcctgataatatccctgttgagtgagacatacatgagggcaatcatagtaaagaacaaggttcaagtcagacagacagacagacctgggtttgagtccataataatacgacttctccctttcccttctttccttccttccttttccctttccctttcccttccctccttctttccttccttccttccttctttttctttctttctctctctctccctccctctttctttctttttttttttttttgacggagtctggctctgtcgcccaggctggagtgcagccgcacgatctcggctcactgcaagctccgcctcctgggttcatgccattctcctgcctcagcctcccgagtagctgggactacaggcacctgccaccatgcccggctaattttttgtatttttagtagagacggggtttcaccgtgttagccaggatggtctcgatctcgtgatcccccactctcggcctcccaaagtgctgggattacaggcgtgagccaccccgcccagccgacttccctttcaagtaagattgctgtgtggattaaaagagaaaaatcagtgtgaaatttatcagcagtgtttgaagctctatacatgagaccattttttggctgtactctctttataggtaggaggagacttgtcagaggtcacacagaagcctagtggcagagccaggacaagaacccattaccttgacattagagtaatgaaaccctccatgagcccccatcgttccacaactctgaaattccaacatctgtttgctgttgggcttttatttagttggcaaacactgatttgcatttaatgccactcccttgactaggtactggggatatggaggaggataagacataaagataatcaccatgggccaggtgtggtggctcactcgtgtaatcccagcactttgtgaggccgaggcaggcggatcacccgaggtcgggagttcgagaccagcctcaccaacatggagaaaccccatctctactaaaaatacaaaattagccgggcctggtggcgcatgcctgtaatccgagctacttgggaggctgaggcaggagaatagcttgaacccaggaggtggaggttgtagtgagccgagatcgtgccattgcactccagcctgggcaacaagagcaaagctctgtcaaaaaaaaaaaaaaagaaaaaaagaaagaaagaaaagaaatcagatgaaggtgctaagtgggccctttgtttttctcattctacagcctcaaccctcccttggctttatttatgttttgctgatgacattcaaatctacatcttcacagcaatactttcctaccttcaaactagaatatccaattttttcctgcgagtctccatacaaccagaatagaatttgttgttgtctcccacaaatctgcttcttctctgatgaaccccacccaggtacccaagccttgagtacttgtttcctacatctcactctccccaaatcctatggattttgctgcctaagtatatagtactttgaattcctttatttatctccatttccagagtttgtagcctagccccggccactgtcatctcttccctgggcgtgaaacagattcagagtcaggtgtcttcagtgaccaggatatgttggcctctgtcccccttccaggacttggcacgtgctgtcttctctttggaactctcgccaccactcctgatctgggctcgcgatttcgttccggaagctgtccctgttctccgccccgggcttctacattctacagcccatcacttttccctgtaccgtaggaacagtgtttgtcttgatcacttctctacctagtaattagccgcgcttagtactgtattcattcatcacatgaatgaatgaagaatgaatgacagacgggtcagatcaccgaaagcctcaaaacgcccacaaggaaatcggtcgcactttatcgccaggacttaggccagtgcctggaaaggccccgaggcaacgacacggtcggctgcccaggctggccccacttcacgggcccgctcgcttccaccctggacaaagtttggccctaatcgctccccgttgtagctctaactggctccagtctcactggcctacatgccccgacaccggcccgatctaaaggcagaagatccggaaagtctgggatcagtgcgcgccagcccaaccccctcactagacactagttgccccgctcctacgaagggtttcagccacaaggtctcccggcctccggaattccaatctcttgccagacccctccctcacatcgttcctcccgaggaaacgtgacccatgccggccgccgtggccgccccaacctactagttcgcctttcctccgcgaacggttctcccggccctcgcgccgctacccaggctcagggggcggggcctcgatgcgacccagtgcgcttgcgctgaccgccccggctaggcttaaagagcaggcggggcagagacccatacctttggcgctgagtcgaggccaggaaggggcggtcgatgagagggcggccttagcattaggagtgcgtcggctgcaccctggcggatggaccttgggaaggaggggaggggaccatcggggtcggcggggagctacgggtatgcatagctcatagagcgtcagagctgacgacgactagtggaagatggggaaactaatgctcagagcgggacagtcactacctcaggggcacacaattgataagggtgggggtggccgtggtaatggaggccccaaggaggggcaggggcccatagtacgtcaggggctgagcctgtattagaacccaggcttgtttcccagcccagccaagtcccagaaaaatccccctgattttatctatttttttttaacctgggataccagcagggaaagcattagaggcaaaaggaaaggattttcatttttccaggaatgctgaagtcaggactgtttgaggggagccctgtgtttctcagactctcttgtaccgtttacatcaggatctggggcagtttttaaaaatatgcggattcatgattcctaccccccacctcattgcttggcagcccccaggtgccttccctgtttcttccttctgggttgtgataggcttgtctgcagtccgaagcacctgatacgaattttagttaaatggaatgtatcagtccagcttctagggaattaaccataaataagacacagccactgctttcagtctgataagataggcaataaactgcctttctgaaggaatcagggatggtttttggggtcttgaaggatggataggaaggtataggtagtgaaggaggtaggggtagaggtgagaggctgggatggggacagtgttccaaattgcaggaacaaaagcagcaaaggctggctgggtgcagtggctcagacctgtaatcccagcactttgagaggccgaggcaggtggattacttgagctcaggagttggagaccaggctgggcaacatggcgaaaccccgtctctactagaaatacaagaattagccgggtgtgttggcccgtgcctgtaatcccagctactcgggaggctgcggcgtgagaattcttgagccccggagacggaggctgctgtgagctgagatcacgctgcagcactcctgcctgggtgacagcgtgagaccctgtcctaaaaacaaaacaaacgagcagcgaaggcatataattctgagggttgctcggcttgttttacagacactgaggagtttggtgtggataatgaggaagggcctgagggttgcaacaggacttaggcgcttaggcttggagaggtagcctcagacgccagttccactgagcaacaggagctaagggctttaagcaggggaaggacatggttagttttgtgtgttaggcactggttacagcgtgacaaatggtttggaagtggggagatgggccagagaaagcagagagagttaagatgtgagatcatgaggctgtagccagtgcagcagctgtggagatggagcgaagcgaacagatcaaagaaatttaggagtgagaactcctagtgatcgtaaatcagtggcccaacccagggaccaagatccttttgactctttttttttttttttttttttgagacggagttttcgttgttgttgcccaggctggagtgcagtggcacgatctcagctcactgcaacctccacttcccaggttcaagcaattctcctgcctcagcctcccaagtagctgggattacaggcgtccaccaccacacccggctaatttttgtatttttggtagagacagggtttcaccatgttggccagattggtctgaaactcttgagctcaggtgatccacccgccccagcctcccagagtgctaggattacaggcgttagccactgcgcccggccccttttgactctttaaataaaccatgtacattatctgactacaggacaggctgagtcctccagtctcccgtgtgtggtcacgggatggggggagatggtggcagataggtgtctggttattcccagaacaatgtttcctgatgtcctttcctcgttggcttttgtacctgaggggataagcagctgttaactagaataggccccaggtggcaggaagaggctcctgggtcaaccaggaacaaaagaagctatttctagtgcagcatgaaattaaaaatcaaaagcatgacccagggttctctgtgcaggttcccctcttccaagacgggtgccaagtgatgagtatcaggtgtctatggtgagatttggggaggatcccagaccttaacagccctttggttgaaacctctcacaatgtggcaggtaagatgtctttattcccattttgtagatgtggcagctgagcctcagaagttacgtgacttgttcaaggtgacccagtttgtggtaggactgggagtgaaggactcttgactaagaatctttccagggagcgtttgccctttctgcactctctgcctgggtgctttcctccaaaatcctggcatgactggctcctttggtcattcagatgtttcatccctggaggctgccccaccctataagtctatcacgttatccttttcttttttttgagatggagtctcactctgttgcccaggctggagtgcagtggtgcgatcttggctcactgcaacctctgtctcctgggttcaaacaattctcctgcctcagtctcctgagtagctgggattacaggcacgtgccaccatgcccggctaatttttgtatttttaggagagacagggtttcaccatgttgatcaggctggtctcaaactcctgaccttgtgatccgtccgcctctgcctctcaaagtgctgggattacaggcgtgagccaccgtgcccggccttgtattttcttcatagcagttattcatatctgaaattgttgcttttatttgtttgctgtttccctctgctagaatgtgagccccatgaaaatgggccatgtctgtcttgttcaccactttacccccaggacctgactggtgcctgccacgtggcagatgctcaataatatttgctaactgatggaaatagtttggggagagagaaagagaaggaaaccaacatttaatgaaagctgaggatgtttcaagtacttctcacaaattacctcatttaatcccttcacagcctttcaaggtagaaatcgtatctccattgggtgaataagaaaccatgctaagtcaggtcaagtctgtggtttgttacttttgaggctatagactcgtctgagatccattagtataaaattttgcatcagctacgtggaggaattcacagaccttctcaggctcacttggggatctcagatcaagacacataggattggggaacttgcccagggtctttttggccccaggcctttgctggatcctcactccctggcaaggatggagtccatgtagtggactgtagggaacctgctgaagattccggagcagagggagatgatttgccctgagcctctggtgtctcagacctgagtttgaatcctgactgtgcagaagtcatctcacctctccgaatcccactttcctcattttattttttttctttctttcttttttttttttttgagatggagtctctctctgtcacccaggctggagtgcagtggcacgatcttggctcactgcaacctctgcctcccgggttcaggcaattctcctgcctcagtctcccgagtagctgggattacaggcacatgccaccatgcccagctaattttttgtatttttagtggagacagggtttcaccttgctgtccaggctggtctcgaactcctgacctcgtgatctgcctgcctcagcctcccaaagtgctgggattacaggtgtgagccaccgcgcctggctttcctcactttcaaagtgaaatctgttttttcctaacaataactaccctttattgatctggtcgctaagtgtcaggtacttggctaatgactttacagtcgttatctcactttcccttacctccctatcacatcagtatctttatagcctccattttacagccggggaaaggaaggcttgaagaggtatcctgacttgccaaagatcacagcagcagtgtcagccatggtgttcccacatatgtaccttgggacatgccatgggctcagacttcccaaagctaactgttgaatcaatttcatcctctgttcttggggtttgtgggaacatttgggtctgaattaggtgaaaaaaggtatgcagggatgtacttcactgtgaatggaggccaatcccttaattttgtgtcttgcctttctccctgcgagggcctctctccaagtctggactgtgggttttttttgtttttgtttttttgagatggagtcttgctttgtagcccaggctagagtgcagtggcgccatcttggctcactgcaagctccgcctcccgtgttcatgccattctcctacctcagcctcccgagtagctgggactacaggcgcctgccaccacgcccgcctaattttttctatttttagtagagatggggtttcaccgtgttagccaggatggtctcgatctcctgaccttgtgatccacccgcctcagcctcccaaagtgctgggattacaggcgggagccaccgcacccagccactggactgtgccttttgattggaacatctctgtcagccccagggtctgcatcacacatggtctgcatctgtgcacatggctactgtctctttttagcagtgatatcaccctgcctcatactgttgtttatgaggccatctccccacctggctgggggccactgctttggccattcagagtggaattcctctgtcttccagcccctagcacaggcctgggccagcattgctgctcaggaaatgcctgtggaatcaaagtgaggactgtcccaggtgttgaggatttactgtatgctaggcctgtccctgacactttatatgtgttatctcatttacacccccacagtcatcctgggagggagaagttactctgcctattttaccgagaagaaacagactaattgaagttgggctttgccttaggccctcttgtggtggttgatggcacgagggccaactctagggtctgtgccctggtcgtgtttgaggtgtgtgggctgaaaaagggaagacacacttcaaggctccagggatcctcagagaccttctactaacaggttcccagtccggctctcatttcatccgtgaggacacagaaggttagaaaggggagataacttacttatagaccctcttctccacttgttatatacttatgtatccacttactttttggcaggatggatctgttttgactcaacattgtaccacccatgtagcccagtgcctaatccaggttgatgcccagtaaatacttttacattttatttattatgaaaccactgagaaaggtataaaaattaacagaacaaatacctgtgtacctaccatccagcttgcaaaataaaacactgctaatataaagacctttttgtttccctccatgactgaccccccaacccaagaagtaaagactctcctgatttggtgtttattattcctatgcaatgtttattgagatataattcatgcaccataaaactccccctttaaagtgtgcaattcagtggttcttggtatatttacaagattgtacaaccattaccactgtctcattccagaatattttcatcaccacagaaagaaacctcatccctattagtagatactccacaattctccttctccccagcccctggcaaccagtaatttactttctttgtctatggatttgccttttctgaatatttcctgtaggtggaatcctacaatctgtggccttttgtaactagcatctttcacttagcataatgtttgcaaggttcatccatgttgtagcatggatcagaactttattccttcatatggctgaatagtctttcattgtacagatatatcacactctgttcctccactcatcagttgataggcatctgggttgtttccactttttgccattaagaataatgctgctatggccaggagtggtggctcatgcctgtaatcccaacactttgcgaggttgaggtgggaggatcacttgagctgaggaattcaaggccagcctgggcaacataaggctctctacaaaaaaatttaaaaattagccgggcgtggtggcatgcgcctgtcatccccactactagggaggctgaagtgggaggatcacttgagcccagtaggtcaaggctgcagggacctatggtcacgccactgcactccagcatgggtgacagagcgagaccctgtctcaaaaataattataataatgctgctatgaacattcatgtacaggtttttgtgtgaatgttttctgttctcgtgggtagatacctaggagtggaattgccgggtaatatggtaagtatatgtttaactttttgaggaactgctgttttccaaagtggcagcaattgtatcagagctccaatttttacatcctcaccaatacagttatccctctgtatctgtggggaattggttccaggacctcccatggataccaacatccaaggatacttaagtcccttatataaaatgatgcagtgtttcatatatgcttaagtcccttatataaaatggtgtagtgtttcatataaactatatgcatcctctcatatgctctttaattttgttttattttattttaaatttaaatttatttttatttattttgagacaaggtctcactctgtcaggctggagagcagtggtgcgatcatagctcactgcagccttgaactcctcggttcaagggatcctcctgtctcagcttcccaagtagctgagactacaagcgagagccaccacactgtcctttccatgtactttaagtcatctcggccgggtgcagtggctcacgcctgtcatcccagaacctcaggagaccaaggctggcagatcacctgaggtcaggagttcgagaccagcctggccaacatggcgaaaacccatctctactaaaaatacaaaaattagctgggcgtggtggcgcacacctgtagtcccagctattcagggaggctgaggcagagaatcgcttgaaccccagaggcagaggttacagtgagctgagatcgcgacactgcactccagcctgggtgacagagcgagactccgtctcaaaaaaagaagtcataaatgctatataaattgttatactgtattgtttagggaataatgacaaggaaaaaagtctgtacatgctcagtacagttgaaacattgttttcaaatattttcaagctgcagttggttgaatacacagatgtggaacccatggatatggaggtcccactgtacttgtctgattgtggccatcctggttggtcattgtggttttgatttgcattttcctaatgacaaataatgcgcatatcttttcatgtgcttattggtagtttgtatatcttctttggagaagggtctatttaaatgttttccttatttgtaagttatttgtccttttattattgggttgtaggaattctttatatattcaggatagtagatccttccttatatgtgatttgccaataatttgtcccattctgtggatggtcttttctgtttttcgatagtatcttttgaagcacatattttaaaattttgacgaagtccaatttatttattttttcctttgcttgtgctttgaatgtcatatctacgaaaccattgcctaattcgaaggtcacaaagatttacacttactttttctaagagttttatagttttggctcttaaatttaagtctttgattcattttgagttaatttttatataggatgtgaggtaggtcttatgcatttttaccctcctattaggtgtatttctaagcaatatatgacactttttcatggtatttgcacttttaagtggtaaattatatgattcttgtgcagcttgcttttctctttcagtgttatatcaggagatttatccatgttttaaggggaaatagttcattcattttcactgctctataggtttcattgcataaaaataccaaagtggcagcaattgtatgagagttttgtttattctcctgtgaatggtcacttgggttctctagtattttattactatatatggtaaaaagactaatagatgcctcctgtgcagtgtgttgaaggtcgtgagcatattcagacttacaaggtaatacaaagtttctttcccaaatggttttgcaaatgtgcactcctgccagcagtgtattagaattgccctcattctgcatcctcaccgagacagaatggtcaaggtttctagcttttgtcagtctagtgatgtgaaacggtgtctcgttgtgattttccagattaatagcaagatttgtttttcagtaagtgtttacatggttggatggatgaatgcatgaaagcagaaggggcccagaataaccctttactctgcctgttgttggaggatggcagggctctgggcctagactatgtggctctctgtagggacaccgtggagctagagaatgttgggggcaggctgacaactctagatgtgggagaggacggttgtcaccttgaaactagtgatgggagcttctctctacccagggagaggctatcgtcctgctcttccatctccttgaattttccaagaagggagggagtggagaaagagtgaagccaaaagagaattcctgggactgggcgcggtggctcacgcctgtaatcccagtactttgggaggccaagacaggaggatcacttgagaccaggagatagagaccagcctgggcaacatagtgagatcccacctctacaaaaaatttttgtaaaattaaaaaacaagggaattgcctaaggatgagaggtcacagtggcctaagtgacccttaggaatgaccctttttctgggactttttcatgatctttatattggtgtgacatgaactttccttgtttaatctactgagtttggagatggtcttaatgataataagaaaatgaatagtaatgattatatgttgaactcttatgtgccaggcacttacgccttttctttttaaaaataggtattatctcattcaattcctatgggacaggtactattagtattcccattttattttatttttaaaatagggatgagtctcactgtgttgtctaggctagtctcaaactcctggcctcaagtgaccctcttgccttggcctcccaaagtactgggattacaggcatgagccaccgcacctggctcattcctgttttatagatgaggaatcagaagatcaaagagacagagcaactctgagggtttgcacataggcagttggactccagaactcttaggcatcatgctgtgtggttaacctggctcagccgaatccactagagcaaagaaaagagaggcttgcccaggcttgggtgagaaacaggagtcagaatattcactgggcctggcctgagggcgcagcagggagcagagcgagaggccgctgggaaagatggttctcaaaagcagaagcctcacgccaggggacatggcccatcagcaagcacatgggtgcctcttctgggcatgctggctgctggggacccagaatgggatctgtctgctcctgggtctcaagaaagacctgtcttgtggggtagacagatgataataagcagacttacccataagtgtaatacactcagaaatggggacatgtgatacagagggtgaagagagaacctttatagaaaggacctagtttagttaatgtagtcaaaggaagcccctttgaggaggtgacatttgagtggaggctcgagaagaaggaagcagccatgccccagtttggggaaagagtaaatggcagatgcagagtccctgagacagaaaggagctggtttagttgtaaactctcagaaggccactgtatctggagtgatatgaatgagagggtggggctactgtagatgggctggtcagttggcagggccaggtcaggctgggtctccaggccagggtcaacatataggtctatagccaacatgtttaaataaggcccataagactgtcttcttgctgtccctgagaactgggtgtttgcatatttggaagggactgaatcctgatgcctaggctgggaaagagggtcggggggtggggagaattcttggcttctggccctagaaagctggaacaagaatttggaggctgcatcccactgactcccagatgggttggagggtgggtggcctcagccaccagggccctgtgataaggtggcaccacatactgatagctgtccagatatccttccacaggtgaacggttcatcaaactgtggcgcatccatacataccatgagtaccactcagcaataaagacacaaacatgaaatgagcaacaccttggaagaatctccagggacttatgtggagtgaaaaaagccagtctcaaaagagtacatcctatatgatttcatttatgtaacattttggaatgacagttttagaaacagaggacagactggtggttgccaggggttaaagatgggagggaagttagtgtggttctataagggcaacacctttttattgttagaactgttcagtgtcttggtggcagtggaagatctgtgaattgacacgggtgatgaagtcgtatagaacttaatacatgcagatgtgcgtgcacacacacgctcacaactagtacatgtaaaactgggaaaatctgaataagatcggtacattatatcaatgtcaatagtacagagttactgtactattgcttacaattgcatgcgaatatacaattatctcaatagaaattttaattaagaaatgaaatttggctaggcatggtgaggcacgcctatagtcccagctacttgggaggctgaggcagggggattgcttgagccaggagttcaaggctgcagtgagctatgattatgccactgtactcgaacatgggtaacagtgataccttgtctttaaaaattttttttttaaaaaagggaggctgagcacggtggctcacacctgtaatcccagcactttaggaggccgaggcgggtggatcacgaggtcaggagttcgagaccagcctagccaacatagtgaaaccccgtctctactaaaaatatgaaaattagctgggcatggtggcgcgcacctgtagtcccagctactggggaggctgaggcaggagaatcgcttgaacccaggaggcggaggttgtagtgagccgacatcacgccactgtactccaggctgggaaacagaacgagactccatctaaaaaaaaaaataggaaatttaaggcccaaagcattagatagaatgatagagatatttgtactaataaaattttcagcccatggaaaaaaaatctgaaggctctgctcaaggaggtctcttgtccttgagttagcaaagtcacagggaggtaggcagtgtgcccccagctgtgggagcaagcagggtcaccctcaggacactcaatatagagcggtggtaccctcagaccctctgggtaggtttcccagcttagccttttgggcctccctctgcccctcacccctcaagctgattgaccacgatcacaagggtagagcagagctacagcaccccccgccctccactgctgcttggtctttcatggagaacagacattctcctgctccccactccaccaggttaggtaaggacccttcctggggaggcccctgtgtcaactgtgcttaaccgtctgtgcctgtgtgtcccccagcagcctaagactcctgaaccttcagaacaaacctgatgccaattccaacctggagggcacgggagagtgtttgtttgaagcactgaactacatgggaaactgaccaagcctggggcaagcccatcctgagaccccaggcagggcctcagctttggtccaggatttgtggggtggttttacaagatcctgggatttcacatgtgggccccactaagacctctcttccagaatgttggctgcattgggcactgtctcaaattccacctacagagtggcagacccaaggcttcccgccatagtaccccaacacccacagagccacagctgcatcctcaaattaattgacatcttcccatgggctgagcactttgtttcatttatttctctcaaccacattacaaggtaggtcttctttgtgtatttattttgcagagaaggaacccagggctcagagaagttacgtaacttgcccagggtcactcagcttgtaaatggcagagcaaggatttgaaaaggcagtcctgacatgtggcaggcctgaacgagtccctgcagatgcaaagctgaaggagaaacattgcctgctcttaaggagctaatgataatatcaccagatatttacatagtgcttatgatgggtcaggcacaggctaggctctctgcatgtgttatttcattgaatccacaccacaacccagtggaataaggttatgcctgttttatgatggaaattgaagctccgtgaggaagagggacctattcaaggtcacatagtgagttggaaagtctgacctcctcttgttggcttcttccatcctccaggctggcctcccaggcccctccctgctcgtggtctgtacaccccttctcccttacactcggctaagccttgtccatggcccctgcccctttcatgtctattcttagcatagtttggagcctgcggttgggccacattatctggatggtgacccctgggggtacatcttctaccccagtgtgtcctttagcccttcctgtctcttccagctgtgcagcaaggggcgtgttagaggggcccactacccaggcccttacactgcggcagcctacctaagtatgcacagcgcacgtagcgtagaggatggagcccgcaggacacccttaatgcccttacctggcagggaggccagcacacaaggggctgggggcgggactgggcttcttggggttgagtggttctggaagccgatatgagcagcagcaactgctggcattatctaggctctaagaatagcttgggatgaagagtcagaggttgaggccagggaagaggacaggagcctgttcctactgccccctcctgctgcttggcctggaagctgggaagcctgcctcctggctcaccatttgctctgggatggttttgcatagacacatcttgtccaccactggactggaggaaagagggtacccctgggactcagacctaggctgcttgacctcaggctgaaggcagtgggcccactctctgaggaccagccctcacccaggcccctcaccactggcacagagtaggggtttgtatttttcaaggatcatgctggaagtgacccttattcatttagcaaacactttaaaaataggttatacatacacgatttaaagttcaaagggtttacaagggaaaaaaaatcactctgcctcccttccctggcccccagctaccaaacactgttaccagctttcttgggtgacttccaaaggcagtccatccatagataagcacacagatgcacaaatgtctctctcccccgatttttacgcaggagatggcatagcccatacattcttctgctccttttttttttttttttttttttgagatggagtctagctctgtcgcccaggctggagtgcagtggcacgatcccggctcactgcaacctccgtctcctgggctcaagcagtcctcctgcctcagcctcccgagtagctggattacaggcacctgccaccatgcccagctagttttttgtatttttagtagagacagggtttcaccacgttggccagactggtcttaaactcctgacctcaggggatctgcctgcctcggcctcccaaagtgctgggattacaggtgtgagccaccgtacccggccacaacttttttttttttgtaacctaatgatctatcttggaaataacagcaatgacatattgagtctccactagtgtcaggtactattctaagcattttagatggtttaactcatataatgctcatcacagcactaggaggtaggtcctgtttgtgaatctccaccattaagaggtttagtcattctccaagacttcgtgcctggtaactggcagagccaggactaaaacccaggcagcctcactttagatgaggtgctccttcctcactgctctgtgctgcctcccaagcttgagacatgttgagactcacatcatgccctccctcttcctaagggccaaggtaagccatgtacggtgaacacttaccacgtaccaggctgaggctgggctactgcagtgtaagggagaccaggcctctgtcctcatggaactgtcatcccagtgcccatgagtgtctgccagccaaggcaggaggagggaaacccacttgtctcatacccatgtgcccttgtataggtctgctgttcagacacaccctggtcccatgtccactagtcctgtagtcacaccgcctctgagctggaaggccttagagcccagagttacagatgggaacataggggcccaaacagaggtggacacgagagatcatcaggtggccctggtgagactcatcccctgcctcccgggatctatttcagcagggtgggtggggggtgactttaatccagggcccaaccattgtttgaagttggaaacaattgaaggacaagggagctatagatagatccacagctgctgtcacttgtcccagcctgggcactgggcctgagcattgtctacagaggggcactctaagcagtgaggcccactcctgggggtaggaggttggcccagcccagctcagctcagctcggctctagagataaagagtcagaggccaagacagaaatacagagtcttggaaggcagagagtgggacaggacaacatcgaaagaacaagacccttgagagatacgatggactcccatcaaatatcgacaatactcagactggctgggggtgggagggcagacgcagggcctgagccacaggttgaactcaaggatgcggcatgtcagagacctggaccagagtgggtgctggggtctggagcacctcagcccagctcaggtctttctgtccatccctccagaacagctgttcatgttaatcactcttgggggcagccagtctgaggtacccttgtgtgtgctcggggaggcctcaaggtcttccgaagtgagaggttgtgctgtcaggcctggtcatggcttgaattcactgtatgacatcaagcaaggacctgcctctctctttgcggctcagtttccccagctgtccaatgagagagctggttggcatgatggctgaagggccccttcatcctccaatgatgtcaggagatttccttttatgtgtctaactccctcctcttgctgtggctgaggtcgcagtcccctcctttctttgtcctttgtgaagatgggggacagctggttccccaccccctccccccagtaacctttcagccataaatccatgctgaggcatctctcctctggataaacagccctgatgccttttggctgccctcgtcctattttttgcttcaagcctcagagctggggcccacttgggccctctgcagctgcccagggccccaggaggggtacaaacctgggacaagcaggggcccaaccacccccagtgtgccagggtcgtgggcccctttctgggcctcaccaccttgcactgggaccattatggcagcctcctcctgagtccttcttcctgccaccggcctcaccccttcagtgcatcctccacaccagctgccacagggagcttaggaacacataaatctgaccacactgtcaaattccgtcgctcagagctctttgatgcaaaaaataaataaataaaaatgcctttgatggcgccccaactcctgcaggataaagctccagatctgaatctggcctttgaagcccttcacagtccagcccactacccagtcctgccccactcccctttatgcccctggtggcccagctgcagctggtggggctgcttgggcccatcttcaccccctaccctgccttggagttctaggtcatgctgtccatttcctgtcccctcttgccacctccatgccagacccatccgctctcacccgggtgacagcagcagctcgccccgctgcctcccctgccccttccaagccgttcaagtggtcactatgaaacttcagctcactcacatttctgctctcacaggctccctttgcacttgcaatacaaccctgggtcccttccaagtccttcaaggctctgaatgatctgcctgtccaccctcaccttggaaaactctccccttgttgaccactaggacggcaccttaaacatcccaagctgttttctgcctcatggctattgtatttgctgttccttctgcttggaatactgttccaagggcttcccgcctcaccggcttcttggcactctctggtctcaccttcagtatcgcctcttcagagaggccctccctcacccaccagaacgaagtacacgtaccccattaccctccaggccatacttcttgtttcatgcttaccacttgccacaatctttaattaccttaaaaatgtgtttgcttgtttattttttgcttctccaggggagtgtcagctctatgagggaaggaaccttgttgccatacccctcttcctggcagtctgggtgtcacacttgtttgttttgagtcagggtcttgttcctgttgcccacgctggagtgcagtggcatgatctcagctcactgcagtcttgaactcctgggatcaagcaatcctctcgcctctcagcctcctgagtagctgagattgtaggcgtgtaccatcatgcccagccaatttttaaattttttgtcgagacagggtcttgctatatcagcctaggctggtcttgaactccttggctcaagtgatcctcctgcctcaagccttccaagttactgggattatcataggtgtgagccatcatgcctggttaattttaaaaatatttttttgtagagatgtcacagggagcttacaaacacataaatctgaacacactgtcaaattctcttgctcagagctctttgatgcaaaaaataaataaataaaaatgcctttgatggcgccccaactcctgcaggataaagttccagatctgaatctggcctttgaagcccttcacactccagtcccaactgctcagtcctgccccgctcccctttatgccccagtggcccagctggtctcaaactcctggcctcaagtgattctcccaccttggcctccaaaagtgcagggattatgggcataagccactgcgcccagccttcaaactagcttttatccttcagactcctccgtgttgatgtcttccttgagtatctttcctttcctagacaatgagtgtcttttgttccatgtgtccctcccagctgtagaagcattattcacagagtccttcgatgtctttacccaaagaagaaattccaggcattgggttacattgagggcagatacattttgggctgggatctaaaatcctggagtctcgctctcctgaaatcggaacgaacttcaaaggtcatccagttcagaggcctcagccctggtcgacctctgcctgagtcttccttggtgctggcaggctcactttcctccaaggcagcctctcccgctgctgatgggctgagatggtgaaaagtccccttttgcatgcatccgcatcctgcttcctgtcgctgcccatggatctacttttgaggctacacaagtcacatcagctccctctgctccaggacagctcttcaagtttttttgattttttgttttttgagagggagtcttgctctgttgcccaggctggagtgcagtggcacgatttcagctcactgccacttccagctctcaggttcaagtgatcctcctgcttcagcctccccaagtaggtgggattacaggcacacgccaccatgcctggctaatttttttttttttttttgagacggagtcttgttctgttgcccaggctggagtgcagtggtgcgatctcggctcactgcaacctccgcctcccaggttcaagtgattctcctgcctcagcctcccgagtagctgggattacaggcgcctgccaccatgcctggctaatttttttgtatttttagtagagacagggtttcaccatgttgaccaggctggtctcaaactcctgacctcaggtaatccacccgccttggcttcccaaagtgttgggatgacaggcatgagccaccatgcccagccttttttttttttttttttttttaagtagaaacggggtttcatcatgttggccaggctggtctcaaactcatgagctcaaatgatccacctgcctcagcctccgaaagtgctgggattacaagctcttcaggtattgaaagtcagtatcttacttaagtccttgcaggttatagtatttgttgcaaatcactcagagcattgggtttcctctttgcgttgtcatgtttgtttgtgagcttatctcagcaggaagatgcaccctgggtggtggaagggaacctacgaggaagatctagacccattttgaggcttggtttctcagccccaggttcatacactgagtaggtaactctaggactcagacccacatgataggtgtaagttagacttgctagaggttctgattctccaggctaattctgttggtccctgacaagaaaccctaccttctgagcatccttgaacaatgaaaagaatttttcccactttctgggctttctataaattgctccagcccagctctccagcctctgatgccataggagattaaaatcctattatctatcaggtttggttcgttcacttactaggtatttattgactttctatgatgtgcaggcacttggcaaggtgccggggacacagaccaagctcctgcccttgtgcaggtcttttctagtggcaggaggtaggcaaggtacaatctaagctctacaaagagaattgaaacagtgaggttctcacagagacaatgcggagagaaagaagaaaggaatacataatgtaggattccattcaaacaaattctgaaaatagacaacactaatctctgaggttagaagtcagtattatattgtggatcaagcaagagtcggtataaaaaaaataaaaataaaaaagaagtcagtattctattatcctaggtgagggatggcccgaaggggataatttttcataatttctgtttttgtacagggtacggttttgttttgttgttgcttttgagactgggtctgttgcccagctggagtgcaatggtgtgatctcggcgcactgtaacctctgcctcctgggttcaagcggtcctcccacctcagcctcctgagtagctgagactacaggtgcatgccaccatgcctggctaatttttgtttgtttgtttgtttgttgtagagatggggttttgatgtgttgcccaggctggtcttgaactcctgagcttaagtgatgtgtccgcctgggcctcccaaagtgctggaattacagacatgaggtactgtgcctgacccagggtatgtttactttgagaaaattcatcaaactttataagatcattcactgcagccttgactgtaatggcaaaagactgaaaacaatcgaaatgtctaccgagaggggacccgcgtcatttcctaatggagacacactgtaggactaattcctaatagggtctgggcggctgtaattttgataaatatcgccaagtttggcactgtaatttttttttgagacggagtctcgtactgtcgcccaggctggagtgcagtggtgccatctccactcactgcaagctctgcctcccgggttcacgccattctcctgcctcagcctccagagtagctgggactacaggcgcccgccaccacctctggctaatttttttgtatttttactagagacggggtttcactgtgttagccaggatggtctcgatctcctgacctcgtgatccgccctcctcggcctcccaaagtgctgggattacaggcgtgagccactgcgcttggccggcactgtaattttaaatgtgttcatgtaatatgcacacagtaaagtgcatacatcttagatgtacagcttgatttgttttgcaaagtgcacgcacctgtgtctcatggctctactcagcgtatagagcatttcctgcctcccagaggctctctggtgcctccagccattaccctccctcagaggaccactctgccacttctgtcaccataggcgagttttgcctgttttgaatgtagatggttgaaaatgtagctgggaaattatttctctatatttcgtctagcacacctgtgcatttggaatgggagcgcatcggtcggaggacttcccgtgtgagcctggtctggcctctggctggaaccctggatctggaactccattgttccatgtgtctggcgtctgaggttctcagatcctttcattctcgattctaaaatcctgtggcgtcacggagccctgaatggggtgatggacaggagagcctggaggtgccctgacacattccaaagactgtatcaggcagatggactgccagcgccctgaacctctgtcgagagtgggccacgggaaggtggcttcctgtgaatcttcaatgtggggatctgaaggggctcctaactgggttacatttccttgatttgcttccatttcagccaaacaattccttgattctataagttccagggctggttttcttcatgtatgatttccccagggggtccccagaaagaggatggggagggaggaagagggaaagagggcatcgatgtgctcccacttccaaatgcacaagtgtgccagataaaatatagagaaataagtgcaaagctacattttcagccatatacattcaaaacaggcaaatctcgcctatggtgatagaagtggcagagtggacctctgaggtagggtacagagtggaggcaccagagagcctctgggaggcaggcgatgccctataccctgagtagagccgaggggacacaggtgtttgcgctttgcagatgtctgagaaggatgtccctctccccctacccctcccccctctctctctccctctcactccttctctttttgatctgttcttctccttctctctccttctctttttgatctgttcttctccttctctctccttctctttttgatctgttcttggccattgctcgtctgtgagacttggccaatgctttcctttctctgggcctcagtttccctggatgtatcaagagggttggactagctggtccaatctcagtaggcattctgtggtttcccctctgagtgtccttgctctctgtatctggaggtggggtatttttctgggtgtgtcagactctgcgtgacttggtttctccccgtgagctcttcagtctcctgaacctcttactgccttgtccctgtccccgtcagtctctgcacccagcctccctgtctctcagtggagtgtctctctccgcctttgtgatcccctgacaatgggaggtaaaaatagcccaggggccgtgctggtggagataaaagggaatttgccttttgtgtcctgtggccaggctgggggggctgtgacacgtggagattgctgacatagctctcctcctctgaccttgacagtggcaataaaaggggtagcagagcttcctgccctcaccgtggtgccgaggtaggtgatcagggctggggttggagccgaagggagggcaggagggtgggcgggtgggtgagggtgcccatgggtggccgcgagtcttctgaatctggagtggaggaagccctggtgtttgagggtgtgcatgtatgctgggcactcacccaaggaggctgcattgggagccagagggagtcgcctagtatctggtcttgtgggttgggggatcgtgccctagttcagctcccttgtcactgccatcttccagtgcctgctgccttgggccgccttgaacctccagggtttccagctcctcctccttcaccccagtgccactgccatgatggatgtgagtgaacttggggagtctgcccgctacctccgccagggctaccaggagatgacgaaggtgcacactatcccatgggacggtaagtggagacagagggggaggggtcatagccacagagatgcccttatggactcagaccaggaattgggaggggtggcaccagctcagggctgaaggggcattggggcctgacagctggagccctggacctttcctgcagagtctggggcctggaaattaaaaccccagggacactgtatatcactgtgtgtctgtgagcaagccttggtttgttcccctgtgaaatgggataatagcacctgccttccggagctgcagtttatgaagactcaggctggagcccgaggcctctgagatgagactgatcggcatgtgtgcaggctgcctccgcgtgtccacaaaacttgtgctggggttatttttagtggtttctgcagagccaaagccaccctttattagggacaggaataaaggctgtactatttatgacctggtttgctcataggacaatactaacaataggcagtgtgtaccgaatgcttattgtgtgtcaggcccagagcagatgactttccatgcatcatctcaacaacctggggaggtggggccagcaccagacctagcttcacagggcgccaggctaagagggaccttgtgtttgattcgacactctgctgttgccgtcttgaaagttttaattgttttcaacaaggggacccacatcgtcattttgtactggggtctgtaggttatgtagatggtcctagatggttctagatggtcctgacccaggcacttggcagagcaggggacacaaactccggtttgcagcctgagtccatgcttctaaccaccatgaaatctgggctcctcaaagctctggggacagctggccaggcaggagagcacaggttacagttaggaggcctgggtttgagtcttcagtgaaatagggaaggcaggacccctccctaagagtcatatgcctgatattgaggggctgctctgtatgggacctaaggagatctccataacattttgcatgtgagggaactggcccagagagaatcagggattttcctgaggtcagagggcaaatatggcggaagcaggaattggaacccaaccattaacccagactcatcctccaataaggggatctctagggaccctcccagctccgcccttcctgagcctgggtttggagggttcttcactggaactcctgggtcctggcagaggggctttggggagggtcacagctgtatggataccatggcttgggaactccagctagaacctggaggtgcctcagcccctctctgagtccagagctctctctgcaacccagggaagaagcgagtctgggtgcctgatgaacaggacgcctacgtggaggccgaggtcaagtcggaggctaccgggggcagagtcaccgtggagaccaaagaccagaaggttccgttccccctttcctgagattagcctctctgtccctaggcctcctggccaacaggatctgccctctggttgaagggggtctgggtatgtgggtgggggtgacaggtgaggtcggtcggttcctcccggtcccccggcccctgacacgatctccctggtaggtgctgatggtgcgtgaagccgagctgcagcccatgaacccgcctcgcttcgacttactggaggacatggccatgatgacgcacctgaacgaggcctctgtgctgcacaacctgcgccagcgctatgcccgctggatgatctatgtgagccccaggcccgggccatgggcggggtggggcttgtatgtggggcggggctagagatgaggtgctgggggcgggcccatagcggtggggcggggctgtgagcggtggatcggggctgtgaatgatagagcgggtccatagcgggggtggggctgtgagcgatgaggcggggctctgagcagtgggggcggggctggaggttgggccttgggaccttaggggagcagctgtagcagtgcggggcgggtctagaactcacctgcggactatggaggccgtgcgtgtgggctggggcagggctgtgagcacaagtcaggggtgaggccaggacggccacagagggtgtggtgtggcaagtcaagtagctccttgaggaatatcgcagggttcttctgaagactggggcctggggcctggggatgggaacttgcgtatccctcccaaaaccctacctatggggggagaatgtggtggcccatgcctgtaatcccagcactttgggagggcaaggcgggcggatcacctgacgtcagaagttcgagaccagcctggccaacatggtgaaaccccgtctgtactaaaaatacaaaaattagccggtcgtggtggcacgcgcttgtagtcctagctaccctgggaggctgaggcaggacccaggaggcggaggttgcggtgagccgagatcatgccgttgtactccagcctgggagacagagcaagactccatctcaaaaacaacaacataaaccctacctatactctctcttcagacctactcaggcctcttctgtgtcaccatcaacccctacaaatggctcccagtctatacggcctccgtagtggctgcttacaagggaaagcgccgctcagattccccgccccatatatatgcggtggcggacaacgcctacaacgacatgctgcgcagtaagggccgcctggactcctccccaaccgcagaccccgacctcggtcccgggaggcctctgtaagggacccccttcccccactggcactgccccccttttgacgctgctggacatggtcgcccagccgttctgtccctccgcatgggagctgacctccactagggacagccccacctgctccttcccattcctggctctgggtggtggggtctgccccagatggatacccagggtgttccacctgtggctggccccacaccttggctgacttctctatccccttccctttcctccagaccgagacaaccagtccatgctgatcacgtgagtgtggggctctgggggtggggtggaaaatgctggccatctggcagaaagagggcggtaccacagtcatttcccaggattgaatccaaagtgcttaggccaggacttttaccacctggagctagtgtcccagctgaagctaaattaggcctgagcactttccctgcccccattctgaacagatgtgttcttgatgggggatagggaggggacacccacaaacggagtgaccaccagccccacacctcctctccccggggcctggaatctcccaccttgatcctctggggttctaattctggctcaggggcagcggaaagattcctctgcttttcctcctttttaccatctacttatgtctgaatcttacctctgatctttccattgcctctgtgggaaaatggtagaataattcttacatgccaggctcatgtccagtcaggccaatatggacaatgtttagtgtgagtgtgcatgcgcgtatgcagttaagagcaagtgccttggccgggcacagtggctcatgcccgtaatttctgcactttgggaggctgaggtgggtggatcacttgacgtcaggagttcgagaccagcctggccaacatggtgaaaccccatctctactaaaaatacaaaaaattagctgggcgtggtggcaggtgcctgtaatcccagctactcaggaggctgaggcaggagaattgcttgaacccaggaggcggaggttgccgtgagccaagatcacgccactgcactccagcctgggccacagaatgagactccatctcacgaaaaaaaaaaaaaaaaaaaaaaaagcaagtacctttaacccagacgggcccggctgagtgtggtggctcacacctgtaatcccagcacttggggaggctgaggcaggaggattgcctgaggccaggggtttgagaccagcctgagcaacatagcgagaccccatctttaccaaaaaaaaaaaattgaaaagttaaataaaaaatcctacctaccacacaaagttatgagtcagtgagttgatatatgtgcctggcacacagcagggacagccacagaactcctgaggcccagttccttgttcctaaaatgggggtgataatggagcctgccttccagggttttctgagctgtaactgagccaatggagtaaagtgccgggcactgagttagtccgtagtggacaatggcatcatcgtgtgttgtcatctcacagggatggtctacactggcttgctttgtacacctctgagggttgatccatccttgggggtttcaagctggggggaaggagaggtggagggctctgcttgaggggtgaggcattgggggtgggggagaattaggccagatgggcattggtgactcatgtttgtgtcgtccaagcggagagtcgggggccggtaagacggttaacaccaagcgggtcattcagtactttgccatcgtcgctgccctgggagacgggccgggcaagaaggccgtaagacttgcccactcgggcatgctccccgttgcttctcgctgtttttcttttctttcttcctctcttttttttttttccccctttttaaaaattttactccccagaaccctgagccctgcctgagcctcccaccctggtgggggactctggcctgagcaaggcttgaccacaaaggctgtggccacctgacgcgcctgccttcgccttcccattggtaaacatggaggggtggggccacgttgccgtttctaaatttgtgtaatttttatcttccattgtgaccttcatatattgaaagagtttactagatgggctgcttttactaagcgttgttgtcttggtttccctgacagttacctgctgctgacacattagacacagaggttggctggcatgcagggcactgggcattcccagcagccggggttggcagggcaattttgtgccttgtgatttctgtacagtttttggaaatttctgaaacaatggggccaagtttttttgtttttgtttttaaggcataacatttcatccctagccttggggccagttgttcagagccctgtggctacccctagatgggctgcctttttccagaagcccgaggcctccctccccacccagtccctgctcctggtcctgttaagccttgctttattctgggtgtttttcttgtttttcccctgttttctttctttctttcttttctctttcttttttctttcttttcttttcttttctttttttttttttttttttgccttttcctttttacccatttgattgtcttgatttttgattttcatttcagttttgttttgttttgtttttgctgttgactttttggtcctttttcctccttccctttcctgccctgtcttccaaatccctaaaaaggtctctggggacgtaacagaaagttgggtgggtcaagtgacaggaagagatgtcagggagaggccagagctggcagggacacagctggaagggcagaggagcacctgggcagaaaggagctgggacagtggagcccaggggagagggtcgggcaagggaggggtgggagaggctgcccgcaggagccatggctgcaggaacttaaaagattgatcagctccccttaccttggccccaaatttggccaaacgggctagagagagccctgcacaaaagcactggatgggagtgtattggggggttccacctcccctgcccaatgtccctgtgggtattttaactcttgggctccctggaggtgaatgaatgaccacaaagtccgtggtggtatatctgttccctccagaatccattccttcccttctctccctttcttccttggctcccagcatccggagtagggaagagaaggaaaggaaaaggaagggaaagtgaggatgaggctaggatggggagaaggaggatctgctcaattcacttagtccccctgggtgacacacaggaccgctgtggcgtccaggcggcaggatgctgggcacctgccctgccgctcctgacttgctgtgtggccttgagcagatccactccctgcccagagctaagtctcctcatttgcaaattagggctaataatgggcacctggcagggcctttgtgcgcactggtaggtatacaggcagacaaacaatgaagacacacccagttgcattacaaaggagaggtgtgtaaggtcatagtgggaggttagggcaggaaggttcagaccaggaagaggtctattccagctttggagcagccaggaggccttcctagaggagggggcacttgggctgggctctggagggccctagattttagtcgggaggcccctggggcttggagcagggccactgcatggagactagaaaatgaagggaggccagaggccgggctggggcagaggaggctgcaggtggagactctggctggggctgtgccactcccactttccagcattttgcctcctaacagctgcaggagggtcaggccgaggggctgagggtgggggccatgcattccggtgactaactccacccccctgtcctgctgcccgctgcctcccgctgataccctgccccaccccgcccttccccaccggaggcctggccctctaatgttgtctgtcttcttcccccagcaatttctggcaacaaagacgggggtgagtatggggccaatgtcaatggggcagccctgggggtacccccttcctctgcacaacagaggggccacgggtggctctggcctcccggtgggtaggcaccagaactgacagaccccctcacccccaccgccccagggcacccttgaggatcaaatcatcgaggccaaccctgccatggaggcctttggcaacgccaagaccctgaggaatgataactcctcccgctttgtgagtggctgaggtgggaggggtggcggggatgccgtaggccaccagcggcaggtcgggcacaggtggggacagtgctggctgtgccccttggctgagggctgcccctctgcccacagggcaagttcatccgcattcactttggtccctctgggaagctggcatccgcggatattgacagctgtgagtcaaccccctgcgggcggtgcaggggaaggaggcctgagcccggtcaccccaactcggcctctgtcatcacgacttctgggctcctgcctgctctgggcacttctctctaccccctggctgctgcccagctcaggccacctcacctatcaccagaacatcaccccagcctctgcctggtctccagcttcctctcctctacgcggccatagttttgctggtcatatcctgttcctgcttgaaagctttctctagatcctgtcacctgaggatggagacccaaatcctcatttggccagtcaggctcctgtgactgcacccctagcgtgtccccagtcttctctctggccaccaagagggcaggcctggcccacggccctcctgccccagctgcacagctacacgtagagtgccccatccttccaggcaccccgctgggaagtgccccagtaccaccagctgcatagaccccaggcgcctaggccacactcaagggggccagggacacagaggggcccccacgttggccactccccacattgggctgcatggctaggtcttgacggatgagcgcaggcaggcagtgacggggacagggataggctgtaattcacaccctgacccctacacagacacacacagacacacacggaggctcggccacacacgcacacacgctgacacaccaacagataaaaacctgcacacgcagacaccacactcaccccacacacacgcaaggacacacactgacccatctggccagagacacagacacacaggtacagacacacggctcgtgtgatgacgcaggcacaggggagataccctccccacacaagctggcaggtgcagatgcagcccccctgcacactccctgcccacctctctccctccgcatcgcccccttgggatgtccactctggggaggtgtgggagatggcaggccagcgtcccttctccccagatctcctggagaagtcgcgggtgatcttccagttgcctggtgagcgcagctaccatgtctactaccagatcctctcagggaggaagccagagctgcagggtgaggggcagtacgatgaagggggtgggagtcagaacctggaggggctgcctggcgcttcctggcccccatcaggccaggccctggtggtctttccctccctgtcctggggtctgtggcctctcttccttcttgggacttttggttactttcctgctagggaacagtcctcttagctccagcaacctgccaacgtgttatcgctgcctccaggagcctaagccctaaaccccacttgctgtcctgagactagagaggtcccacccagcaccaaggcggactgatgactgtctaggcccagctctcctctctggcaagcccgttgagggcagagtctggtcttccctgtgcgccagcatctagcatgggatctgggccagagggggccatgagcaacagtcaaaagatgagtgagacgtgaggactgtggctcattcctcagagaaccagaaaaagaagccagggtcaaagtgaaggccaggtcagggcccttcactctcagtgccctcagccttggcaggagtgaggatgagaaacttaggccccagactgggagatgaggtcctctgggagggccctagactcctgctgggcttgcccccgcaggaccccctatgctgcaattgttgtggggagaatagccggtaagcactgcctgaccctcccttctctgccctgtgtccccagacatgctgcttctgtctatgaacccctatgactaccacttctgcagccagggcgtcatcaccgtggacaacatgaatgatggggaggagctcatcgccaccgacgtatgagctctggtgggaggggagctgtgtggacgcctgtggtggaatcgggcagcactgccggtgcccccagctgcatgaatggtcccggggcagtgcctggctggaccctggaggagcccagacctctctgaactcgctttccctgctgccccccagcatgccatggacatcctaggcttcagcgtggatgagaaatgtgcctgctataagatcgtgggcgccctcctgcactttggcaacatgaagttcaagcagaagcagcgggaggagcaggcggaggccgatggcactgagagtgaggggccctaacctggccttcaacttgacccagacctcagcatcctgtccatgatggttaaccccaactcttgtccacaacctttaacctcagtcttacctggccctgcctcctcagctccaaacccttaccctcctgaggctttgtttgctagccctgaacttgacccctcttaacttccctctcctagccccaggctgaggcagtagagcccctgagtgcgcatggtggtgtcctcctcccttaccccactcgtgccctgccaggtgctgacaaggctgcctacctgatgggggtcagcagtggggacctcctcaaaggccttttgcacccccgggtgcgtgtagggaacgagtacgtgaccaagggccagagtgtggagcaggtgagctgcctgcaggccaaacccatgggggacagccgggcagggtcccctccttgccaggtcccagcccagcctccctgcacctccaggtggtgtttgctgtgggggctctggccaaggccacctatgaccggctgttcaggtggctggtgtctcggatcaaccagaccctggacacaaagctgccccggcagttcttcatcggggttctggacatcgctgggtttgagatctttgaggtgaggacaggccctcaccttggcctctgttctctccaaggtagaggacatgggcctgtgggggggcagaagccctggccttctgcctggaagttgggggtgaactcatgcccctccccgggcctccctttccccatctgcgagaggtctgctgagccaggcccctccctcttgtagttcaacagcttcgaacagctgtgcatcaacttcaccaatgagaaattgcagcagttcttcaaccagcacatgtttgtgctggagcaggaggagtacaagcgggagggcatcgactgggtcttcatcgacttcggccttgacctgcagccttgcatcgacctcatcgagaaggtgggtgccgcggcaaggtcactttgaggaagggagggtgtgtgtggtgagcaagcagggatggatgaccatggcttgcatggaagcctgcaagtgtgcatggaagcgtgtgactgtgcgttgcagtaagcatgcatgtgagtgtagttgtgacagcgtttatgtgcttgtgtgtgaaagggcacgtgtgtgagtgggtgtgttggagttgaccatgagtgagccttggtgagtgtgtgagcagtgtgaatgcatgcatcccagtactgtggacaacagctcctcctgggtgctcagaattctgcagctcacaaggccctatttgcagccacaatttcactggatccctagaactgccctgggtgcagggcagggtgtgtttccttgtttttgtgattgtggaacattatgtatatttacccattgtacaaagaatggaagaaagaaaatttgaaaaattggcaggggaaaaaatgtttctccccattcctatcacagccagtcacatgacacttaggttcatttcctcgaaatcctttatccctttttttttttttttttttttgagatggagtctcactctgtcgcccaggctggagtacaatggcaccatctcagctcactgcaaccttcgcctccagggttcaagcaattcttatgcctcaacctcccaagtagctgggattacaggcatgcgccaccacacctagctaatttttgtatttttaatagagacatggcttcaccattttggccaggctggtctcgaactcctgacctcaagtgatctacccaccttggcctcctaaagtgctgggattacaggcgtgggccactgcgcctggcctatccattttcttttatagacacagatttcatttcatatcctactttttctctgaaaatgtattttgaatgctgctcatggcaagagtagttcatgcagtggatgagtttcatacgatgcatttctgcagtcccctacagctgggcgtttaggtgattgacagctttttaaatattatgtcagcactgaagacattcatcttcccactctgcaggttagaagactgaggcttagtgatgtcggagggccccacagctagtgagtgaggaagccaaaatgtgaacttgatggctttttttgacttaccccatgtttgtgtgtgacagccatggctgtggcgggggtgagagtgggtacagagatgccagcttgggtttgccattgttagaagtgaagatgacacctcagtgctgcagattttgcaggaggggactggagccaagccacaaacttttctctgttaggagatgggttcttggagtgggtgtggtgtctgaccatccggggagatggctgaagctggggatctgggaaggctcccagaagggaggtggcctggggaaccaggggttcagtccttccaggatggactggcttgatggtggcttttcaagctcgttctgttcccagccactgggcatcctgtccatcctggaggaggaatgcatgttccccaaggcctcagacgccagcttccgggccaagctctacgacaaccacgcggggaagtcacccaatttccagcagcctcggcctgacaagaagcgcaagtaccaggcccacttcgaggtggtccactacgcaggcgtggtaggtgcttgctggaaccccagccctcggccaggctcctcccgccctgctccaggtctcccacccgggctcagcacctgacttgtctctccaggtgccttacagcattgtgggctggctggagaaaaacaaggatcccctgaatgagaccgtggtccccatcttccagaagtcacagaataggctcctggcgactctctatgagaattatgcgggctcctgctccagtgagtatggagggacaagatctccactctgacaggggcccacagagcgacattccctggagtgaccaggccccttgtctctattagctgagccccccaagtctggggtgaaagagaagcgtaagaaggcagcatcgttccagacggtgtcccagctgcacaaggtaaggccccatctgggagacagaccctccctcttggcagcctccagccccgtccttcaccccctgccctgtcccctgtgccttgggcgggcggctgttaagacttgcagtgatgtttaactcctctccacgtgaacatcacagcaagtctgtgctgcttcccgtccctacgctgcctgggcagggtttgtggggaaggggtgggagccctggggctctgggagggacggggatttggcagggaagtgaagactttggtggtggtgatgggagacagcgaagggtctcccatcaccagaatgagagtgaaagagcaaaagtgcagggcacttagggccctgctcccgtctcggtcctgaccactgcggcatccaattctggttctctgccccctttgtgcctttccctcactcttccccactgccaggagaacctcaacaagctgatgaccaacctgcgggccacacagccccacttcgtccgctgcattgtccccaacgagaacaaaaccccaggtagtcacccagggctggcctggctggggccgggaggcatcatgggaaggtgacagggcagaggccgggaggctgagtacatcttccccctcacctcgcagggtctccactgctgctttttctctggggcctgcgggtgtgcctgttgacctctgaccttttcccctctcacgtccaggggtcatggatgccttcttggtgctacaccagctgcgctgcaatggggtcctggaggggatccggatctgccgccaagggttccccaacaggttgctctacaccgacttccggcagcggtgggtgaccccttccccctgcctgctgctccaggtggaggcctgaggggctgggcaggacacacatatcagagcccaacagacggtcccctgtctggagggggaagcagggactgtgaggggcctggccaggtatcccagcaagacatgggggtggctcagacctggccggggacttggggagaagtgaataggcttggggcaaatagtggaggtggagcctacaggcctcgctgataagctggacatggaattctggatgcagaaaagacgaatgatttctagttttgggagtgagcaacctgggagctaccagtggtagatttactgagctacaaaaacagggttttttgatttggaggagaggtgaagggatactggtttgagctctgttttgcgtgtatcaggtttgaaatgcctccagcagacatcctagaaaagtcatgggggagattgggattatcaatctggagctcagggcagcgggcagaaaggatgcagatttgggagttgaacgagaatcatgtggacgaggcttcatgagacacctggcacatagcaagcacctgggcagtgctgccagctcctccccgttccctcaatgggcaacaagcatccatcgttccttctccctccagaagtcatggtgtcatccacactatcctttgtaaacagaggttcacacagataccatacacgcacacacacgcatggtgctgtgaccttgttttttctaacagtctggcctggagatcgttccttatccccaggcgtatgcctgccatcgtcatccgtttttcttggctgtgaaacatctcacagtctggtggactgcatgctttgtttaatgagtccccctcatgaggggccttcacagcgtggctgtagcccacctgacccacacagccctgtgcatgtgtccacttagaagtgggcaggctgggagccctggctcttttgcattagaatttccccccaaatgggctgggcgcggtggctaacgcctgtaatcccagcactttgggaggccgaggcaggcggatcacgaggtcaggagatcgagaccatcctggctaacacggtgaaaccccatctctactaaaaatataaaaaaattagccgggcgtggtggcgggagcctgtagtcccagctactcgggaggctgaggcaggagaatggcctgaacccgggaggcagagcttgcagtgagcagagatcgtgccactgcactccagcctgggcgacagagcgagactccgtctcaaaaaaaaaaaaaaaaaagaattttcccccaaatgtttcttcagtgatagggtacagcatgtcaccttctactaatattttttgcctttaaaaaaattttaaaaatagtgcatgccttctgtaaaaagcctctttaaaaacttaatgaatgcatttaaaatccccccaaggttgtgtttttttttttttttttgagacggagtcttgctctgtcacccaggctggagtgcagtggcaggatcttggctcactgcaacctctgccttctgaggttcaagcgattctgcaattcttctgcctcagcctcccgagtagctgggattacaggcgcccgccaccatgccccactaatttttgtgtttttagtagagatagggtttcaccatgttgcccacgctggtcttgaactcctgggctcaagcaatccacccgccttggcttcccaaagtgttgtgattatgggcgtgagccaccgcacccagccaaccccccagggattttaagtggagtgtccctagtgtcccagtgtggtgacgcatccctggcccccttgtttggcatgtgccctgctggaacctctgcaccagcctcggagaggcccaggaacgagtcccctgctacccacacgagcctcctcagtccctgacttccccattctcagtggcctgtgccccatacccagccctctcctgaccagctctgccctcctttcccaggtaccgtatcctgaaccccagtgccatcccggatgacaccttcatggacagcaggaaggccacagagaaactgctgggctcgctggacttggatcacacccagtaccagtttggccacaccaaggtcggggcactgtgggatcagggctggccatggctgtggcggtcacactgggcagggttcatgcggatggttgggggttaccctggctgtctacctctccgcccccaggtgttcttcaaggctgggcttctaggcgtcctggaagagctccgtgaccagcgcctggccaaggtgctgacgctgctgcaggcgcggagccgtggccgcctcatgcgccttgagtaccagcgcctgctgggaggcaggtgggtgtgggaaggaggctggggacagggtgtgtcccctgcctctcagctcccagacccactggctctcccaaccctaacatgctgccctgtagtcagatcagcccctgtggctggttggggcaaggttctgttctgtgtcccccagcctccatttccccacctcaaaaaacggggtacggcacttgcctctccatttcaggacatcagcgtgtggcccggaggggtagcgatggcacccagtgtcttccaagactcttgcgggccgggccccaggcaagatactttctctgcattatcctggttaaagcgctgacggtcctgagaaacaggcgctgtgatggcctccactcagcagaagggtgcccgtgtcagagatccagagctagctggcacgtcagcccaggccgctgactccagagccccgtggcttaacagccctggtgtcttccgggaattgcagaggccaccaggacatggggggctcatgagccccttcactggaggcaggcctgtgggactgtgggcctcccctcaccctcacctataaagcagagctattaggagctactccatgaggctgctgggaaggcaaaacaagtgaactgtgctgagtgtcaccatttgtgacgggcagcactgagccaccttcacagcttggctgcccctccctagggatgcgctgttcaccatccagtggaacatccgtgccttcaatgccgtcaagaactggtcatggatgaagctctttttcaagatgaagccgctgctgcgctcggcgcaggctgaggaggagctggcggccctgcgggcagagctgcgggggttgcgaggggcgctggctgcggccgaggccaagcgccaggaactggaggagacgcacgtcagcatcacccaggagaagaatgacctggccctgcagctgcaggctgtgagtcagggttccccttgtgaccgggcgtccccagccccgagtacccctggctgctctgagggatagtacagcgagacccatggggctcaggccttatgtctctctgttccaaagatgccatgagatgaggcctccatgtcccagcctcaccaccccaaggcctcgtctggcacgtttcctggcactctcccctcgtgccaccttggcctcccgctaaagcagaggaaccccagctccccagctctcccctccctgcaatccctgaaaccaaacagacccatgctctcttctctggttaagggccatgggaacccaggtggcaggtaacagggtgatagccagagagcacagatcaaaggtctggaatctccccaggtccacagagcaagctttcctgccttcggcacatggctttgtgtatcaattgtgtgccaggctcaggctagtgcaggaggaacgttggtgggaagacagagatggccctgtggtcacaaaactcacctgctagtgcaggagactgtgacgcagctggacagtaaggaaatggggggtaaggatacctgagcccttccagggactgcctccaggagcccgtccgtggctgtgcagaggctgctgctgctcaccctgcccctcggaaggcctcagcccaacagcggggcagtgagcagcgggcttccctctcagaacccttgtttgggcctcactctgggccgccccgcacttctaactttcccctcttaatgctctggtgtgtccctctgcgctattgcccttccatgcccaagagcgagtcaagacattcctgagttctcagagcacagccaaactttgctacagaggcagtttcctctccagggcctggcctggtgtctctctgctggtttacctggccctcccccaacctggccccgttccgtgtgccctccaggagcaggacaacctggcagatgccgaggagcgctgccacttgctgatcaagtccaaggtgcagctggaggggaaggtgaaggagctgagtgagcggctggaggatgaggaggaggtgaacgctgacctggccgcccgccggcgcaagctggaggacgagtgcacggagctcaagaaggacattgatgacctgaagctgacactggccaaagctgagaaggagaagcaagccactgagaacaaggtgtgggccgggccagctgtggggaagggccctgagccaggggccagctttggggccaggtggctgcaggtcccaccccggctctgctaagcctctgctttctggccctgggcatgtcactgcctttcctgggcctcagtttctttatctgtcaagtggggttagcagcacttaccccattagggtaggtggtgatgtgtgtaattggcctttactgagcacacgctcctaggccttgcacacggtaggtgtttagcacatgctggcaatcctcatccatcccggagtgcaagccccttgagggcaggaactccatgtccccagctcggcatcccgcaggtgacttctgcccttgagccctcgtgatggcccctgtggttcccagtgctggaggagggactccattacacaggagggaaagtgaggcaggggtaggcagcttaggttctcacaggtgctcactgaggaagccgggactaggaggcagctgccctgagcacatgctaatactgcacatggctggcatctgtggatttctcaccaggccaggtgtggtgctgagcactgcgggtgcatccactcgtgaatcctcattacaaccccatgaggagggtccttccctcaggcagaagcggtggaggctcggagtcaagtgacttgcctgagtcccatagctggaaggggcacttgctctgacctggtgtggtgtggtggccgctcagagtgcggggaagggcgtccccattctggccctggccctggcacaggtgaagaacctgacggaagagatggctgcgctggacgagtcagtggcccggctgaccaaggagaagaaggcgttgcaggaggcccaccaacaggccctgggtgacctgcaggccgaggaggaccgtgtgagcgcgctgaccaaggccaagctccggctggagcaacaggtggaggacgtgagtcagggccaccccgagactgggtggcggggccggggtgccggctggcttgggccatggctgacccctgctgtgcctgctctgcagctggaatgctccctggagcaggagaagaagctgcgcatggacacggagcgggccaagcgcaagctggagggtgacctgaagctgacgcaggagtcggtggctgatgctgctcaagacaagcagcagctggaggagaagctcaagaagtaggtgtggtggggcagcaggtgggggccttctgagcctgcacctggcccttgttcccttctggattcttgtggttcctgcggcattgcagaggttaagggtgggggttgacagatggggcactggggtgcaggggtagtgtcttgccctccctgtactgagggccctagccagggtccagggctgaggcctcagggcccagtgcagcaggtgcatggggtgaggtccctcagggcctgaaggggactggggggcgttatggggtcccaggcgggtgggtgggagttaaggcctgtgctggccacccactctgtggctcccaggaaggactccgagctgagccagctgagcctgcgggtggaagacgagcagctcttgggggcccagatgcagaagaagatcaaggagctgcaggtgcgtggggatcgggtgggtgaggcctggggtcagaggcccacagaggtgacagctgccccacgtgcccaccccaggctcgggcggaggagctggaagaggagctggaggcagagcgggcagcccgggcccgcgtggagaagcagcgtgcagaggcggcgcgggagctggaggagctgagcgagcggctggaggaggcaggcggcgcatccgcggggcagcgcgagggctgccgcaagcgggaggcggagctggggaggctgcggcgggagctggaggaggcggcgctgcggcacgaggccacagtggcggcactgcggcgcaagcaggcggagggcgcggcggagctgggggagcaggtggacagcctgcagcgggtgcggcagaagctggagaaggagaagagtgagctgcgcatggaggtggacgacctggctgccaacgtggagactctgacccgcgccaaggtgtccgtgccttcctcaccccatacccaccctgactttaaaccaatcccgatcccagcagccaatactgttcccacaccagcctccacccagtaccttatcctgagccctgacctcttcacctggtacacaaccctcatttctcagcctcctaccagtcctgaccttaagccgtgactcccaagccctgttccctgactccaggtcatttctgatccagcatctacttccagcctcagacccttgaaccagcagtagttgtgaccctagcccttgactcctgaactctgacttaatacctgtcctctcttcctgtcctgaaccccagcaccctagccttaacccctgacctttctaccacataatcctgacagctgacctctgaccattgtccccaggtgactccgcagctaccatcccaactctcaccctgacccactgccctgggactggcccagccctgtcagttctgacacctgttaagcccagcagtagaatctctttccctgactttgaacttggggctctgctctccctttgattcctgggcccacatctagcttaccagtctctgatcccagatcctgccatctgatgcacaaacttgttctgacatctaactcctgacccctgactcccaacctgggatcctaggccagtgcagagaagctgtgccggacctatgaggatcagctaagcgaggccaagatcaaggtggaggagctgcagcggcagctggcggacgcaagcacgcagcgtgggcgactacagacggaaagcggtgaggctggggctcagctggccacaccaggcagggctttggtgcagccctcaccagcctgacctgtccgctcgcctctttgcctgcaggggagctgagtcgcctgctagaggagaaggagtgtctgatcagtcagctgagccgtggaaaggccctggccgcccaaagcctggaagagttgcggcgccagctagaggaggaaagcaaggtgggctggcaccggtgaccatggagtgggcaggtgggcaccagagccactgggctgcactaacgctgaggtcactggtgtccctgcaggccaagagtgccctggcccacgccgtgcaggctctgcggcacgactgtgacctcctgcgggagcaacacgaggaggaggctgaggcccaggctgagctgcagcggctgctgtccaaggccaatgccgaggtggcccagtggaggagcaagtacgaagcagatgccatccagaggaccgaggagctggaggaggccaagtgagtgctttgctggccaggccactgccatgcagagctttatgcctgtgcctgagccccgctgagggtgggtgaagggagctgctggggctgttctccctccttccatggtccacaccttgtctggttccatggcctagaaaaaagctggcactgcggctgcaggaggcagaggagggcgtggaggctgccaacgccaagtgctcatcgttggagaaggccaagctgcggctacagacagagtcagaggatgtaaccctggagctggagcgggcgacctcagcagctgctgcgctggacaagaagcagcggcacttggaacgggcactggaggaacggcggcggcaggaggaggagatgcagcgggagctggaggcggcacagagggagtcccgtggcctgggcaccgagctcttccggctgcggcacggccacgaggaggcacttgaagccctggagacgctcaagcgggagaacaagaacctgcagggtaggacctgccacacgccagggccagggtgctgccctggggtcggagcaactttgagttatgggggtgccctggtggggccaccctggaatcaggggtgagtggagtgacctgggtgggagtacaagccatgggggtggcctctcagcaccctgtccactgcagaggagatcagcgacctcacagaccaggtgagtctcagtgggaagagcatccaggaactggagaaaaccaagaaggcgctggaaggcgagaagagtgagatccaggctgcactggaggaggcagaggtcaggggctggctgcaggggtgggtggacactgacctgctgctccactggccatcccccccccccaccctaccctgcctgctctgtatccacagggggccctggagctggaggagaccaagacgctgcggatccagctggagctctcccaggtcaaagcagaagtggaccggaagctggcagagaaagacgaggagtgcgctaacctgaggtgtgtccatccttctcccgtccccacctcccgagagcagaaggggagggaagcagtgtgtactctgctctctagtctgtccctcccatgggactttgaggtccgggttgctgtctccattctagctgtgaacctcggagatgctaaaggacttgcccaaagtcacacagtgggggtggagccagtcagtccacctctgtctgcctgggcctcactcttgtccatgaacttgctctgatgggccacaggcagtcacaagagactttaaatcggggaggggtgactcatttgttctcaaaatgggttcgtttccaacggtccttgggcatttgtaaggacaggtatgcccttacgagaccccctttcatgccaccctcctcccataggcgcaaccaccagcgagctgtggagtccctgcaggcctccctggatgcagagacacgggcccgcaatgaggcgctgcggctcaagaagaagatggagggtgacctcaacgacctggagctgcagctgggccatgccacccgtcaggccacagaggcccaggctgccacgcggctgatgcaggcacagctcaaggaggagcaggcagggcgggacgaggagcagcggctggcagctgagctccacgagcaggcgcaggctctggagcgccgggcctcgctgctggctgcggagctggaggagctgcgggctgccctggagcagggcgagcgcagccggcgactggcagagcaggagcttttggaggccaccgagcgcctcaaccttctgcattcgcaggtggggacaggagtccctggggacagagcaggtgcaggcctgctggctggctggctctgagactcctcttcccctcagaacacaggcctcctaaaccagaagaagaagctggaggcggacttggcccagctgagcggggaggtggaggaggctgcacaggagaggcgggaggctgaggagaaggccaaaaaggccatcactgatgtgaggctgggcaagggctgtggggagcctgggacagaattgcagagggacttccctgaggctgggcacctgaccagctcctcctccccaacaggcggccatgatggccgaggagctgaagaaggagcaggacacaagtgcacacctggaacggatgaagaagacgctggagcagacggtgcgcgagctccaggcccgccttgaggaggcagaacaggccgccctccgtggcgggaagaagcaggtgcagaagctggaggccaaggtgtgtgcagcccctctagtccttggcgcaggcagggtgggtgacccaggggtgggcttggcatcaggctgtccccctgcctgcaggtacgggagctggaggctgagcttgatgcagagcagaagaagcacgccgaggcccttaagggcgtgcgcaagcatgagcgccgtgtcaaggagctcgcataccaggtgggcgacagggtctccctggggagtggccctggagctggcccagcccaagcaagccctgagtcccccttgcccgcccaggccgaggaggacaggaagaacctggctcgcatgcaggacctggtggacaagctgcagagcaaggtcaagagctacaagcgccagtttgaggaggcggtgagtgcgctggggcctggacacctggaccgggcaccccagctctgccccagggtctgtggccaggtgaggcatcagcagcagctccaccctccaaggtcagtgacccagagggaagagagaagcttctaacatctctggggagatcagacctagctccttctcatggaacagaccccatgtgctttcccctggccaaggctggggctgcctctgaggggtggggcaggcacaaaaaggcacatgaagttggtgcgtcccaacttccttattcccgctgtggtattggtgaggatggacagtggcaataggaacaaagttgagaaccaggaggagctagctcccttcttggactggggcagggaccagaataagcatctcagtcacccaagcggaaccaaggccctgtgtgtgcccccaggagcagcaggccaacaccaacctggccaagtatcgcaaggcccagcacgagctggatgatgcggaggagcgggcagacatggcggaaacccaggccaacaagctgcgggcacggacccgggacgccctgggccccaaggtgaggagtggcaggggcattgctctctgtgcagggggactgtgggggctgacaggtagtactgctcactcagctatccctttctcctcagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctccatttaattggtttatttgctgttaataaattggcaacacaaggaagggccccatgtccaggctcaggcaggagcggctgcctcaggcagaggcagggcaggcacagctgccccgtgccccaagggatggagggaaaggcccctcacttctgggagaacccccttggatgaacacagcggccaatgagcaaacagaaccagaggagctacaggaaaatgaggcagaggggcaggcttgggggaaggcagcattctctggtacccaccacccctgcccagggctcagaagcctttgcctgggtccaaaggccagggacaagggaggcttggctcacagatggggggtgggggtcacccatatcttcctccccactctgggactgactgacagccaagaaaccggcaggagctcacacagagctaatgctaaatgtcctcttacctctgggtggccctgggccccagggttctgaaggaaaggtgggcatggtaccctgtcctcattatggggactgaggctctccatgacctagggccctcagacccagggggaccaagggcttctaggacttccctcccaccaagcctgtacccaaagacctggggcaggcagagagcagcagggaggaacgggaacagggcagggcgtgtggcatcgtacccacgctcacccacactggcccagcagcctcccgaggcctggcccaaggtcactcctcagtgaagtccctgtctatgtccatgtagggctcctcaatgtagctaacgagagcagagggtgactgccggtccgggttcaacaggatggacactgtctccttccagtatgagaagctgatgcaggagctctgggcaaagagggaggggctggggggcgcctggaggacccaggtcaagcccagcaccgggacacccctctgagaggccctgggtccgcggcccacccatcacccccttgagggtggggcactcacgttctctaggcaggtgctgtccttgtccttgtgcaggtagtgctgctgccagaagcgcagcaggttgtggaagttgttgagcaggaagccggggtacttcttgctgtgctccatccgctgcagcagccgcaggtacaggggcagccgctctttccgtcgggccagcatcaggatcaccaggctggtgttgaggcagctgacgttctcctgcaaggccacaggcccacagggtcaggggctggtgggagccccagtggcccctggtgaacctgggtagccatcaggcagggaggagagtggccccaggcctcgggccacccacagagctctccctgcacagaggtgagataggactgggggaagggggcccccagcagccccagtttcctgactgagcaccttcctcttccccacgcccacctcccaccccacctgaggcaacaacacctgtccctgtccagacctgggctcaagcatcactccttccggaaggtccgtcccaggcagggctgggtgcgtgtgttggggcggttatcccgcttcagaagtgccattcagcactagcctgcgcgcctcggtggggaaagagttctgccccactcaccatgcactcccacctggtgcttcacctcagaacggaaccaaagaccacctctgagaggtgctaagatcaccctcactctagaaaagaggggcaggaggctcagagaagggaaggctgcatgactattcagtgagggagttgggcagcctcaggtccgattccaaagcccagcagggcagaaggtgtgagggacgtggacatgggggaggcggggagagcactggcctgcaagtcagcctgtgacctgagggcacttgcgagccctccttccttaggccctgtctgtacaatgggacactgattcctcctgagcacagtcctcagaagagctgggtctccagagacgcacttctggagtgggggacagaaacctgctgggcaccaggacaaaggaagtggtttccaatcgaccttccctgctgtgtgtctgccggggcctctcacctgggtcagcgtctgcacgtggatgatgttgatgaggcggaagaggaaggacatctgcgtgggcacctgggatatgtaggcgagcaggcggcattcagacagtacctcggcaactgtggagggaggcaggggtgcagcaggtcaggcttaggcccagtggctgggtcgcccaggcctttcgtggagccccgcttgggtcctgactctgaagctaggagctcatcatcaaaacagcttcaacgaaagctgactgtggcagaaagaaggacctccagctgtcctgctaccaggcaaagccatgttctcagagtgcccaggagcaccccacctcatcctccagaaccaagctcagggcagctctccctcagccctccccagactggctccagacccgtgccctccatatcacacacagaagagttccctccacaggaagatggatccatgacgctgcattaagaaaaacaacgcaaaagttccactccttctgcagaggtcctagcgcaactggttttccacaccagctctcaggtgagtccggcccagtgctgagaccacaaggcacaggttctgctccgtccactagtgtcggagcaactgcttcccgcacaactgggaggcagggcaataaccgaaggtaccaaaatctgtgtggctgttcccctgaaacagaccctctggggcagaaaaaggaagcaaacggctaaattaccaacaaccgggatacttcttgctatcaatgacagtgaccgtgacaaggaacaagtgcctgactttttgggggtgtgggggggtcacaaaccctcaggagaatctgctggatgccacaagccctctcctaggaaaaaaaggaaacgcgtgcgcatacacatggaagtgcgttagcaagtccaggagggttcagatgcctgctgcaccacagggcacctgcgatgccacgcacagcacactgaggacgagggggccaactcatcgtgccaggcaataccagcccagaagaggaaggtctttttctggttttctttgcatcttgctagcaacaatggattttcaccttattaaagtgttgaacaaggcagcaaagccaattgccctggaagccgccaccttgaggccggccacgtgggcatctggtgcagctccctcagtcattcttgtctccctgctggagacagggtgtctgatgccagcattcttaccctgcatgacttgccttgacagcctgcctttcatgtacctttcatatccacctggttttcaaatcggtccagggacagagtgacacagcgcaccagcatgttggagtccaccagggagctgttgatctgcttcaggaatacctggaactatacagaaaccaagctcacagcaggcagtgggctgctggccaggtatggccatggcccggggggatagtcactacaaggggcatcagcgacctctaccagccccactgcttcagataggaagacagaggctcagataagctgagggacctcccctcaccacccaggtactaagaggcactccccggaattcagcacagatccgacactctctccagtggttttacgctcaagggtgctggattcctttaatttttacttttaattttacttcagctagcctgagctgggtttctgtcacacacactcggtgagcctaacacaccaggcccagtccctccctacagcggctcccaccgtggcacccaccatgctgcgtcacggcaggcgcacaagccacccattcccaccctcactccctacccacaagcagccccggttttcatccctgcattcccagggtctagcacaaagccagacagagcaggttccaatgaatgtttgccaaagactgcccagactcccccgtcgtctctaacgtaaaacctgtgcctaaagcctggcagaccaggactccaggtgaacttctggacaacccagcacactccacagagccctgggttaactttacctttgcatcggtgttgatatatttattgaatctcttgaatgcatcaacgttgaacttcatcagctcccccaggaggtcaaagtaactctggagcacatcccttgacttacactcgctgtccacaatgcagtaaaggatgtgctgggtgaggagggacagggtgaaggtgtcaacgtggctgcccccaccagggcctggcatggagctcagaccatgcattggctttgagcaagcatcctggggatggaactggcaacactgtctagattcttgtctgaggatgctggtggctccaaggacaggaccaggcctgacagacctcaccaggaggtggagcagactgggaatgcagcacaatctctcccctgcccagggcgtacagctgaagcctgtgacctgctctgtggtcaccaagatggccggggtgctcagctcctaggtgaggggagctgtcatcaccaggtctaaaacacaggccactgcctaagcactgaggtcattcaagtaaatgaaggacagaatttaaaagcaaaggacacattttgaccccatggtttgtctttgtgtttatgaacgaaattgtttaaatagagtttacaccaaaatactgagttttcatcaagagaataaagccaatttactcctttataaagttttctacattttcttgaagttacattgatttggatcaattcttttccacatggattttataattcgtgggtcagtttcttgtccatatgaaaaaatctgaaagaccaattataactttggccattctgctctaagttttactttttctgaagaccattattcaataaaggaaaattaacttttagtacaaaatatcttcagggtcaaaatgccttgctgggtaaccaaactgtcaccctcctgcatggcctggccaccctctaaacctgtcaccccgtaagcacccatggggaacccacagttggaaacccagggcaaaatctaaggcagcctgcacaggcatttggaagtcacgagatctgctctgctcctgatgaactgtttggggctcaggacaggacacagcaacgcgtgggctggggggagacggaacccaagacactggctgctccagatcatacctccaagaggcctcgcttcagcaggaacatctggtctgcataggaggtggtccctcggaggaaactctccacagcccgagcttgccaaaacctgcgacccaaatactggctcaggtggctaaggctgccctcttccggcccatgttcagttctccaaggggttgggagatgtttgttgccttttcatgtactcaacatttactgaacatctaccaagcatcaggcttcatcctgggcctggggacacagcagtgcccccatcctcacagagagccagctcagtggagaagtcttctatctgggtctgtctggaaggggctgtgtcacagaaagggtaacatctgggatcgaagggctggctcctgcgagcccccgtgaaacatactctaggccttgccctttcacaagaatgggaggacgtgcaattgaggggccaggaatgtgtgtgggaagcggacgaacacatgcagacaggccactgggctcacagacgatgggctggcctagggaagtagtggttgatgctgaccgagggacccagagggcacagcgggtatccacgacagggagtttggacaaggcactgaagtgacaaaggcccatgtgggcatgaagcctcctgacagctcacgcccggccctgatggaactctacctgtccactgacttcaagactcatcttagatgtatctaaggacctcagagaaggtctccctgtattcacccagcccccagccctagcagcggaagaggctttcctttgctgctatagctcctgggccaaccctggctccattccttcccacactgcattgaaacagcacagctctagggaattcatggcagggcccgtatcctagttctctcccacccataaggcaccagcacagaacaggtgcttggtgaatgctcggtcactgtgggctgcagaagaagctctcacatacctgtcgagtcaaaactacacaagatggcagtcaaaccacctctccccaacagtaattgtgcttcaggaggcatggacgctggtgactaaaggaggtattcctaacctcctgagaaacacctggctctgcagccccgcagaatcggcaggtacttttccccagactcacctgaaagacgactctgctggctccttcttcatgacctgcagcagacgagttaataagcccctcttcccatcacacaccaaactcctgaaatagaagagagatattggtgacagatctgagaggctgacaggggccctggggatgggtcattctgctggcttaggcggtgaaaaaccatggggacatttccaagtctgcaggatgccttcctgctccaactgggtccagagccccggagacccctgcagccacagaattaaactgccaagtgcattcccaccacatctcaggccagctttccttcccaggccagaaacatatccagaatcagacatggcttagaactgccagaggagagctgtttataccaaaagtgtgttgaaacaggtcatgccagtctgccagatggggaaagactctgccaatagggtgaggcccagcgtactccgtgcctgaggttcacttccagctggccttgggcaagtgtccacaactccaagcctcagcttcccagtctatgaagcaaaggcaggagatgaggaaatgactctggccccgtcatgggggaaggaagacggccaggcacgcaggggtctgggcccttcaaacagagcagctctgctgtgatccactgcagacatcagggcaggactgggtacaattttatttgaatgaagagttctgctaccttagaaaaaaaagattgggaggccaggagaggtggttcacacctgtaatccctggactttgggaggctcacttgaggccaggagttcgagaccagcctgggcaacatagtgagaccccatctctacaaaaaaaaagtaaaaacactagctgggaatggtggcgcacacctgtagtcccagctactcgggcggctgaggcaggagaatcacttgagctcagaagtttgtggctgcagtgagctataacaccactgctctgcagcctgagagaaagagcaagaccttgtgtctaaaaaacaaaacaaaacaaacaaacaaaaaaggttgggaaatcatggctcttgttggataaagtccactgtattctgacgcctgtgagactagccccccactgcctggctccaggtgaggcaaacctaacccaggtaatgcaacctaacacttggcagcaggtaagaggcttctgtctgtcctgcttggctgcagatgccaccaggcaagaaaggagcacataagcaaaggggctgaatgcacgagacaaggcggtggggcagtgcggagcacacatgacttctggcaggtgacctctctgaggctcacctcatctgtcaagtgcaggtactgatggggctcccctcctagggctgctgtgaggctccaatgagaaaatgcaggtgacatgaatacaatgcctggcacacaggagccctcaggacactgtagctgcatgtgagagaggacacgcgtgcatacctggatgtgctcaccggtgagcccccggggaacgtgggcagccgggatgggctgagggaaaagctgcacccctgcactcacctgtcggtgttgaggacagcttccacctcagggatgttggccttgagagagatggcactgagttcattcagctcctggttgttgagtaacaagtacttgttcctgaaacaaaatgggttggaggaggtaaaggacaggaactggggctgctgggtcagcaccaggctagtgtagggagtctcctgcccacttcctgtggacagaatctgagaagccaccaggcactttcctctagcacctctcactccagccagcacctgcaggagggaactctgggctctcaggcagtggaatctctccctggccccacccccatccccgacccctgcctgccacattcatcgacaaggccccttccctcagcagctctgggcctttctctttgcctacatttccacttgttttctcaaaggcaccaacacctcaacaggtccaatcacactcaagcctggccctgctgcagcagtcccaccaagcaccacggtcacacatcacacagaggcctggttaactgtgacacttcccccgacttgccatccaggcctgtcactgctgggtcctgtgttcccaggacaccagctccctttactaaaaggtatcccacaggaactgagtcatcacacggtgccaaaagtgatcttcagaatcaggactctgatcctgtcactcccggtgaaaacacttccacagcttcccactgcatttagaacagacatttcctgacttaggaggaggttatgtcctgataaacccatcgtatttgaaaatgccgttaagttgaaaacatattgaggccgggcgcggtggttcacgtctgtaatcccagcactttggaaggtccaggcgggtggatcacgaggtcaggagttcgagaccagcctggccaacgtggcgaaaccccatctctactaaaaatataaaaaattagctgggcgtggtggcacacgcctataatcctagctactcaggaggctgaggtagaattgcttgaacccagaaggtggaggttgcagtgagccaagatcatgccactgcactccagcctgggcaatagagcaagattccgtcttgaaaaaaagaaaaagaaagaaaacacatttaatatatctaacccactgaacctcctagcttagcctagcctacctggaatgtgctcagaacactgacttcagcctacagttggccataatcactggcaacacggcaggcacagcacagagtactggttgtctaccttggtgatcgtgtagctggtcaccatttttcttgaaatacattctgagctgcagctgcagctcagtgcccagcattgcaagagtattgaactgtttatcatgagcccaggaaaagatcaaaattcaaaattctacttctgtaccattgtgaagttgaaaaattctaagtggaccatctgtatataaaatccaggcctgtgactgtgacccacaacaccctgtgactgtgacccacaacgtcctgtgcagcccagcccagagccaagcccacatcactcccatcagctggccacaatggtcttccctcgttcaggggcttctggctagaacacacaccctctcacatgcctgttcactcaattcactacaagctgacacttcaggtcttggctggcaagccacttctgcaggggagagttcctgagtgtcctctggccagtcctggaccctgtcaaatgtctctcacagaccccgttcctctcctcctgaataccatctccacttatcactaatgctcaacggtggaatccttggatgaacaactgtctctgttttcagactctgcccttcatgagagcaggggccatggctgtttgcattcatcctgatatcccacagagtactcagactgaagagtctgatgaaagccagagactcacttcctcagggaaaacagcacagttccataacatatgtggtgccatttttcagaaggttaacatgcttcctggagcccttctatggctttcagccggaaaacctctcacagaggatgggtgcatatgatggaggtgccctggggccacagctgtctccaggcatgttctgttagctcaaatgcaaggtttttaaaatatttaaaccaacatttaaaatcaggacctttcacataaatcttaatttctgcctttgcttggcagaaaaaatcagaagttatgcaacagtgggcccagtttcctgtgcacacgcagctggctggagctgagctcactgaaattcttgttcactaaggtccccacatcacctccccaatgccaaggtcaagggtcagctgctagtcacccccttcctgcactgttttccttacagcagagagtaattttccttgtacattctccatcgaaggttaaaaaataaatgagcgcagaatgtctttcaagaaaaatgggagcacacctccttgtggagggaagaatcctccagctgctcagtaagcagtcggctttgcctgtctgaagttcctgccggcccctgggaatagccacgctgtccactcttgctttagaggggcagtaggttgagaaatccattgattccaaaggtagtaaggggccaacgacttccatactcagttcctggggtggctatgagggttagaagaaagcttggggcagtgcctgccataaggaagtctggaaagacgggaggtccgactgcagtgtcacacctgctaacactgaggggacagtgggcttccaccagctccagggcctcctctcgagctgaggtcagggaccagacaaggagatcgaggccttccgaagacagcccaacaactctccttgcagggacactcttgtacttactcgtggtggtcactgaagctctgaagaagcctcaaaaactgtatcttcaaggtgatgtcctgaaacacatgcacagcctcaatgttaggaccacagccacaaggttccaaaataacacaagcagacactctggtgggagcctgcttctctaagcctctgtcctcatgtaccatgaggacttttctttagttagaaaaccatctgttcacttccacatctgatcaacagcagattaagctaatgtggcccccttcctgctaaaaacatgccatcacactcaataaaaaataaggcggggcgtggtggttacacctgtaatcacagcactttgggaggccgaggcgggcagatcgcttgaggtcaggagcttgagaccagcctgggcaacatggcaaaccctgtctctactaaaaatacaaaaattagccaggcatagttgctgcgcctgtaattctggctactcaggaggctgaggcaggagaatcacttgaacctgggaggcggaagttgcagtgagccgagatcgcaccactgactgcactccagcctgggtgatggagactctgtcccaaaaatccaaccaaccaacaaacaaaacaacacgtgtggggaggagcgggggaagtccataggagttagaaatgaagaaaggaccgaggagtttggaatagtgagccaaggaactgatactcagcagctgtgggcagtgtggagaggtggagacaagacctagtcacactaaggcttgggttttaatgccctgcagggactagacagggtgtcaggtcccagtaaagcctggggagcatgtacacttggtgaaagaagggttagaaaggcctgacccaccagcccagggagcctggctctgccatggtgctgctggtgggtgaagggggccctcccaagagcagcagaaaccctgggctcatacgactggggcagtagggccaagacattaaataagaaaactggccctgggacagctgccagacaaaagcaaaagtgccctgtagaaatgcctccagggctgaggctacacaggtatccaagggggaaactaaccccactgacctcaagtgatctgcccgccttggcctctcaaagtgctgggattacgggtgtgagccaccatgcccgggagcacgtttctataggtggatgaaaattacaataggataaaacagcaaataaggaaaagcaggctgctagctcatgcagtgggcagccccctccctgcctggagtgaaatgagatccccatcacagagattacaaggggaagtggctagagggcctcaggcagaatttttttttttttttttttttgagacacagtctcactctgttgcccaggctggagtgcagtggcgtgatctcagctcactgcaacctctgcctcctgggttcaagcaattctggtggccgctccacagacattacaaaacacgaggcaacactccaccctgaggtctgaagacccaaacacaagcattagtgccccatgagcaatcgaaagagaccttaagaaagtattttaaaaatgattaaaaacagaatatgcagcagaaaaaagatattaacatcatggctaagcagtttccgaattgagccagacagaacatctagaaatgcaaaatatatttgcttgaaattaaaaactcaaatgataaagcagaagacaggtcgctgagggaagtccccagagtgcagtgaagagaagagggccccatggcaccaggccgatggctgggtggcacttttaggtcccagagcactttccttctcatgctggtaggcagggtgccgactagccggggggccaataggggaaagagtattatccttcttttgcaagaaaacagaggctcagagattcagtgattcattcaagctcttccaacaagccttccaatgtcctgttcagagctctctcaaggggactgtgagagacacaagctaaaggagagtgcttgggctcaaaaaaccaaagccacctttttttgtatgagacagtgtctttgctctgtcacccaggccggatgtgcagtggcttgatcttagttcactgcaacctctacctcccgggttcaagtgattctcccacctcagcctcctgagtagcagggattacaggtgccccaccaacatgcctggctaatttttgtatttttagtagagacggggtttcaccatgttggccaggctggtctcgaactcctgacctcaagtgatctgcccgccttggcctttcaaactgctgggattacgggtgtgaccaccacgcccgggagcacggttctataggtggatgaaaattacaataggataaaacagcaaataaggaaaagcaggctgctagctcatgcagtgggcagcccctgcctggagtgaaatgagatccctatcacagagattacaaggggaagttggctagagggcctcaggcaggaactttttttttttttttttttgagacacagtctcactttgttacgcaggctggagtccagtggcgtgatctcagctcactgcaacctctgcctcctgggttcaagcaattctggtgcctcagcctcccgaagagttgggattacaggcacccaacaccatacctggccaatttttgtatttttagtgagagacgcaagtgtctctcacactagtgagacagggtttcaccatgttggccaggctggtctgtaactcttgacctcaagtgatctgcccgctcggcctcccaaagtgctgggattacaggcctgagtcactgtgcccagcctaggaagatcttaaaagggatttctgcataggttggggtggggagtggagttcactcagatcctactccaaggtagcttccaattaggggactataagatatgattttagtttctgctctactcccaaaggaaaaaaggtcaaagggtcagcagcaggtcttgaaacaactactccaagccagtgaggccccatctgtccccgggggtctcctgcttaccgggctacagtcacagttctggttgtgaccatggaggacaagggcagatgctgaatgcttcctccaaatcagtttgtcaaacaaattattaagtccagggatcagcttgaactctgcaatcattctgtgaacctgaatgggataggaaggaaaaagtattaagacaaatgtgcttgaaaaatctagcaaaacctcgtgctcagtacacacgataatgatattcaggacaagtatcagtactgtcagtaaggagggccagggtctgaagaaaacatccgtgtatcccctatgcccagcacacacaaacccactttctaactttgctcattaatgctcacaataatcctacaaggcataatgtccggtagttcctatcacagaagcatgagtttgggattcagagagtcctgcatatgattcaagagtcctttgggatgcaagagtcctgggtttgactcttagctttaccatgtgcaaactttgtaaccttaaacaaattccttaagatttgtctcctcgtattaacatcaaaatgttcctcatgctttgcactaggataaatttcagctgaaagtaagatacaattattaaaaaactctaagatctagaaaaatctctgcaaagaaaaaaaaatgatctaagagttggaaaagcctttctgaaggattataataaacctagaagctcaaaaagaagcttgttgacatcaaccacctaaacctttaaaaattctgtatggcaaaactcaagcaaagtcacaagccaaatatgacaaacagagaacatacattggcaattcatgccacaggcaaagaaattcctctataaggagtcctacaaatgtctctgatttttcactttttcagactgggaaagatgacaaagctttataagaccgtgttggtgacttgggcattgggtacattcacacgctgttggtgggagggcacactggtatgacctgcacagggaagagtgtttggcagtagctctaaaattgcaaatccataatccctttaaaccagcaattccactttaggaatttacactcagacagatccatataaacactaaatgatatatatttacaacactactcactatagcattatttgtaataccccaaaataaattatggtatgccactcaatgggatacaaggcaccagtaaaaaagaatcaaggtattttatatgtcgtgaactgaacaattgccgagagataatactgggaaagcaagtgtgctcatgctgtattactgattgtgtaaaaaaagaggaatacaattcgcctttgtaagcataaaaatgtctctagaaggatacactaataactggtaaaattagctgcttcatggaaccattagaatagaatgtcaaggatcagaggggagagaggcttcacttatactaatttatatcttttaaaacagaactgcaggaatgatttccctgttaaaatttgtttatataacataaggctattactagcccttctcggggctgttgtaaggatcgagtcagaaagcagatgtaaagctctgcacacagcaccagtgctcgcttattgctattttacaagggggagaagttcagcaagaccagcctgggtaaggtcagtgattgcaacggcacctaactcaggtgttcagatcttaagtctgcccctttctagcccactacaggtatgcatttatcttgggagaccagaagctgacaaagacatccctggcagcctccatttccatggacctcttccttcaacatattaggttgtgtaaaagtaattgcgatttttgccactgaaagtaatagaggtgactattctcttcctactagaaatcacagcctctggccagtgttaagactcataagcagcccagaatctgttagactgaggctgatgtaaaatgacacctgttctgccactcaggcctttactaaaacccagcctggatctaccttgccctgcttaactgggggtggggaggtacggctgacatctatggtgttcaccaagccatgtgccttcctgtctcactccaaagggccctaagccaggcccaggtcacacagctataaaatgttccaacaatggcccaaaaaaattcatccagtgcaattgcctcactgcacagactagaaacccaagcttaagagattaggggtgagtcacacagctgggaagagaggggccttctaaggcagacttggacctgaccctgggtctcctaagttcaggccagtgcttaggtttgaggtttctactacatcatttcccttttctcttaacaataccagcttctcggccgggcatggtggctcacgcctgttaatcccagcactttgggaggccaaggcgggcggatcacttgaggccaggagtttcagaccatcctggccaacatgatgaaaccctgtctctactaaaaatacaaaaattagctgggtgtggtggtgtgtgcctataaccccagctacttggagggctgaggcaagaggatcgcttgagctggggaggcagaggttgcagtgagccgaggtcatgtcactgcaccactccagcctgggtggcagagcaagactgtctcaaaaaaagaaaaaaaaaaaaaaaaaaaaaagaaagaaagaaaatagcagcttcttcatgtgtaaaatttgtaaaacaaattttacttgtagaatgcattattcctactctcaggtccagccccgtagcctgctctatagcaggatggtaggcaggtgggcgagatgaagtgccactctaccagaggaggcagcgggtacaggctcaggcatttatctctgcagtcagacagccctgggttcacaagatagctctgtgaccctgggcaacattctttgaacccaagtcccttgatagaaaaggcgatgggggacgatggagctgttgaaaaggctcagtgaggtactgtagaagctactcagggggcactaaaagaaacgactgctatatggatggttttcattagcaccagagggatgaaacttgacagcacatggggagcctttccagtcctgagatttcaatttggccaagattggtctgagaacttggcccaactgctcattaacgaggaggcctctttaaggaggaagccttctgtgaggcctggccaaggaaacccttccccttgctacccagtgtaggcaggatctgggaatccagatcctcacggtgcccggcacacagcagaaacccaggaaatgctgactgtgcaaatgagaacacgctagtgaaacagtggttttggggggccaggatttcaaggtcattagtggtcccttcccaaggaaccagcactgtaatcatacagtttaactcaagaccgcaacaactcatagcaacctggcaacaagaaggctcagggaacagagaactgctgtgagagggcagaaagaggagacagggcagcagagtttaaatcctggctctatccaggcctgtcccctgagcgcacagcccagtttatgccctggctttctcaagaatcgagtgtggggacacagagtcaccacctgttgtgtaacttactaaatacctgaaaattcaaacaactgtgaaagtgcctcgaaaaagtaatagcactcaatgcacagaagctgtccctacaattatttcacatataagcaactgcgaaagtgcctcaaaaaagtaatagcactcaatgcataaaagctgtccctaaaactattattttttattaaaaacatgttccgtattgaaggaagggacaccaatgctgtggctatcaccgtgggatctcatccagtgtcctggttttaaatacaaccatatgctgaggactcccaaagtgatacctccagccttgccatctccccaacaccaggtgtaggtaatcaatccaagtgtcaattctaacacacacctcaaatctaccttgtacaaaacacaactccccatcttcctccctaagcctgctcctccaccccttacctgctagtcttaaccacctcaatacctggcaaatccattctcctacttccttgggcgaaaaaccttgggagtcacccttaactcctctcctcactcttaagttcacatccaaaccatcagcaaatcctatctttcaaaacatatccagaatgcaaccacctcccaccagtcccaccatcaatgtgctggtcctagctgctatcatctcttggccctattatgagggcccctaatggtcgccctattcccttccttgctgtttccagtctttccaaaagcagtcagaggaatgacttctcacttcactcagagtaaaaaccaaagtctttaaaatggcctgtgacagcttgacatgacctggtccctgtgagccctcagccctcctctcctggctgtttgctccaggctgtcccgcgctgcctcactgttccagcaactatgcacactcctccccagggcactgccccctcccacctggtacactctttcattctcttctggacgttttcatcctcacttgtaaaatgggggtaactgcacctctgttgcccagacttgtgacagtccagtgtctgactcagaaagatgtggaaggactgctgagcctccagcctctcctgcccccatgcttggtttcctccctagaagggcgcggtctgcaggaaaaggctacttctcaatagtcttgaggagggccgcactgttccaagccctttttcctccactgtaggttatgggcccctcctcctccgtcttggaactacttcaaggctcagggaaccttgcacatctggagctccctgtacttgcccagttttcctaagcagacacagctctgggctctgtcccactgccctgagcccacatcaggttggcaactcctctagcatgtccacagggccaggcttgccagctttcaactctttagtcttcacctcacagaggcaactgcctgcttctgccctcagcaccaaccaagactgcctagaaacgctccatacagcaaggcacagtgaaaagactcccggttctggaatcagcctggtttccttataggtagaacagaaggagaaatacccctatgctttgccaggctaaagcgagagccattctaacagaaggcccagtggagcacctggcataccatgagcacccgggcagcacctgctccccgtgtcctgagacgctggagaggggcccacctggtttcgctgacgccccatcagcagcacgcagaggacatagagcacttccagtttgtacatgatctcatgcataatcttcattgactggggcagctgggttctggctgacgtgtgaggcaggccattctcctcagaagcccctggaggagggaacacaatggaggctgacacagccaccggagacaggattgagtcacagcttgtgaggaaacacgtttctgcccctcgaacctgctctgaacagacttgtagcatggccattcggctgggccatgagcccaaaacacagactctgaaagctgcaaaactccctccacaatcccaggagccaggtgagcgcagagactcggaaaaatggactctgcaatagttgtgcctcatcaactttaacataaagtaaaaatattcggacacagccaatacagtaacatgacccatccctccctgcttatgcccttctcctgccaccaaccagacccccaggaagtgcccaggcagatgtatgacagcaaattatggggaccgctcttcaagtcgcaaatggccctgcttacttggttcttctgctgagactccatgagggacactgctgaagcccaagagggattctttttgaagaattccccgttttttaaaagaagaaccatctaaatttttctaaggttcaactttctaaagcagactgggtatcacaactgatgctactgatgcagatgaacatattatctacaggcagattttcattttacccaatgtcattactgctaacatcaacagcagctaagtgatatttatgggacacttgatatgtgtcagacttgctggctttatgactttgggccagtcacctcctcactaggccttagactgctctgcagcagacagctagggttactgtgcagactgaatgggaacgtaagagaagcccagcatctgattcttaggaagcccccattcactcctagatcctttctttacttatttacagagtcttgctctgtcacccaggctggagtgcagtggcatgaccttggctcactgcaacttccgcttgctggtttcaagcaagtctcctgcctcagcctcccgagtagctgggactacaggcatgtgccaccacgcccagctaatttttctatttttagtagacatggggtttcaccatgttggccgggctggtcttgaactcctgacctcaagtgatctgcccgcctcagcctcccaaagtgctgggattacaggcgtgagccacggtgcccagcgtagatccctactattttaagagggcattggtcagagtcaggagaggctaggtgatcttagcagagtgacttcccttcagtttcctcattttaaaggtgaacagatgaatcagtaactgccaaggtcctctcaagttcctacaggaactgcttccctagaggccttttgcaaaggcctctatgtgttatagaggagtggttatcagatatattcaggtaaggctcatacagaaaacacagtgatactctttaaagtatcaagacagaagaccctaacttattccgactaggtgtggtggctcatgcctatgatcccaggactttgggaggccgaggcaggtggactgcttgagcctaggagtttgagaccagcctggacaatacagtgagacctcattgctataaaaaaatttaaaaaattagctgggcatggtggcatgcgcctgtagtcccagctactcaagagggagaggtggaaggatcgcttgagcctggaaggtgaaggttgcagtgaaccaacagagatcgtgccactgcactccagcctgggcgacagagctggactgtctcaaaaaaaaaaaaaaaagagagaatctaacttactctatcctacagacttggaactatctttccccgtcatgttaaaatcacaaccttggaagacgacaagctgctgaatgaagtgtgactgagacacagtgtgacacggtagttaagagcactgaccctgaagccagactactgggtttgaaccccattcactagccgggtggtcttcagtaaatcagtggacctctctgtgcttcagtatccatcctcctttgtaaaacagcaatactgacaaccatacctaccccttaatgttgtaaggagtagagggatatactgaaggtgcctggaacatagccccaagtaagcaacatacaattagaaactaaatagaagttaagttctcagaaaactgagtttttctgcgaatgcttgcttgttactttgtattctttttcatctccaagcttttaatgggaactaaacaggcaggaggcaaagacttaggaaaaatttactggagaaatttttaatttaagagattctatctactcatatttattctcctgtaccttgggcaaaaaactatagttactcaatttccatgttagcactccttggcccagcttccagaacagttaagtgtcagctaatctgtgaagtgaacctgaagaactatcacgcagaatcctgcctctgtcgtgcactgctgtgagaccttgcgtgcttggcatcctcggcacccagcccatggtgctctagggagtcctgcagggaaggatgtttatgcaagcagtgggcacagtgtggggcacacaagtcctactgagaaatgaacgtctgcgaagaaagagacagggcagcctgacccctctccaagtcaccaccaacttttggtgcctggcttgcgcaggcctgacaagactttctgtgataaatattttcaagaaacagtctccaaagcaatggccagagcttagcaacaaggtcagtcccaaggatgaggatgggaaaaccagctcacgaggcctgtgctcccctgagtctcttcagctctaccacaccgattggagcggtcaccactctctgtctgcactgcactgttttctgcggacatgcacactcacttttttttttttttaacagctttgaggtacaattcacataccatgcaattcacccatttagttaaccatggtatcgtgatttttaggacattcatagagttgtgcagccattaccacaatcaattttagaatatcttcatcaccccccaaaagcagccttgtactcactaccagtcacttcctatttcccaccaaactccttagctctaggcaaccatgaaactattttccatctctatgcaattgcctgttcaggacacttcatattaatgaactcatgcaatatgccatcttttgtgactgcttctttcacctagtacaatgttttcaaggtttatccatgttgtagcccctatcagcattcccttttattgctgaataatatccgctagtataaatatatcacattctggcttggtacagtggctcaggcctgtaattccggcactttggaagaccaagacgggaagatcatttgagtgcaggagtttgagaccagcttgggcaacacagcaagatcctgtctctttttattacaaaaaataaaaaaattagctgggcgtggtggtgtgcacctgtttccagctactcgggaggctgaggtagaaggatggctgagcctgggaggtcagggctgcaatgagctgtgatcacaccactgcactgtagcctaggtgacagagagagaccgtctcaaaaaaaaaaaaaaaaaaaaaaaaaaaaaattctgtttattcattaatcaggtgacagtcatttgcgttgtttccatattttggctgttatgaatatgctgtgatgaacatacctgaacaaatttttgtgtaacatatattttcatttctcttgggtatatacctgggagtaggatttctaggccctatgacataactgtatgttaaccctttgaggaactgctagactcttttctaaagtggctgcactattctacatgcccactaatagtgactgagggctctgatttctccatattcttgccaacccttattatccaccttttttgatgataaccattctagtgagtatgaagtactatatcattgtggggtttgttttttcctctatcatctagactacttaagtgcagtggcaggatcacagctcactgcagcattgaactctggacccaaacaatcctcccacctcagcctcccaagttgtcaggactatgggcacgtgccaccatgcctggctaaccgaaacaaaatttttttttgtagagatgaggtcttgctctgttgtttgagctggtcttgaacaatcctcctgccttggcctcccaaagtattgggattacaggtgccagccactgtgcctggcctcactgtggttttgatttgcatttccctgacggctaatgatggtgaacatttttcacgtgcttaataattatttatatatcttctttggagaaacatctattcagatcctttgtctatattttgaaatgggtttttttattattgttatgagagttctttatacattctagatacaaatcccttattagatatattatttgcaaagatgtcccaccctgccttacccacaaaaaacgttcttccattctgtgggttctcttttcactttcctcattgtgttttctgaagaacaaaaagttttaattttgatgaagtccaatttattatttatctggttgcttgtgcttcagatgtcattgtgtatgacagctaaattgttaaatccaaggtcatgaagctttatccttatgttttcttctaagggtttcacaggtttagctcttacatttaggtctttgacccttttaattttgtatatgacataaggcaggggatctaacttcattctttcgcatgtggacatcaaatggtcccaataccatttgttgaaaagactactactgtttccaccaatgaatggtcttggtacccactgaaaatcaattgatcataataagcatgagggtttatttctgaactctcaacaatattccattgatcaatatgtctatcctcaggccagcagcatagtgtctcgattgcagctttgtagtaagttttcaagtcaggatgtgagttgtcttaggttgttttttttttttgagacagagtcttgctgtcacccaggctggagtgcagtggcacaatcacaggttactgcagcctcaaactcctgggctcaagctaccctcccacctcagcctcttgagtagctgggactataggtgggtgtcacgaggcttgcctaatttttaaattttttatagagacaggggtctcactatgttacccaggctggcctcaaactcctgaggccaagtgatcttcctgcctcagcctcccaaagtgctgggattacaggcatgagtcactgtacccggcctagttcaagactgtttttgttaatccaagtctcctgcatttccacatgaactttaggatcagctactccatttgtgcaaagtagtcagctgagagttatgacagaaattgtgttgaatctgtaaggctgatctatagatcagaatgggactatcattatcttaacaatattaattttctgattcaaagacatgggatgtctttacatttatttagggtttaatttctttcaatgatgttttagaattctcagagtataagttttacacttaagttcctaagtattttatttttttgatcctattataaataaaattgttttcttaatttttggtttgttgattgctactctatagaaatactactcattttttaatattagccttgtattctgaacctttgttgaacctatttattagtttactggtttttatagtagattccttagatttttctacatataagatcatcccatctgtgaacagtttcactacttttctaatttgcatgcctttaatttctttttcttgcctaactgccctagccagaacctccaatacgatgctgaagagaagtggcaatggcactgccacttccagaaacgatcaggaactcgtcttgttcctgatcttagtggtagaagctttcaattttttgccattaggtatgtcagccatgggtttttgtagatgccctttaacaggctgaggaagttctctcctgagtttttgtttttaccatgaaagggtgttggattttgtcaaatgcttttttgctcctatggaaacgatcatgtggtttttgtcctttattctattaacacagtgtattacataaactgattttcaaatgttgaaccaaacttgcataaatccatttggtcatggtatacaatccttgtatgttgctatacttggtgtgctagtattttgttgaagatttttgcacctataatcataagagatactggtcttgtgatgtctttatctggttttggtatcatgataatatgacctcaaagagtaagttgggaactgttccttcctcttttattttctattagagtctggaaagtattggtgtgaattcttcttgaaacatttggtagaattaaccagtgaagccatgtgggccaggacttttctttgtgggcagtttttcattatttattcaatctcgttgttatacttcaggttttctatttcttcctgagttagctgcaatagtttgtgtcttttaacttgctcatttcatctaggttatttagtttattggcttatattgtttatagtattcccttagagtcctcttactttcttaaggttggttgtaacgtaccttctttcatttctaatttagtaatttgagcctttcttttttggtcagtgtggctaaaagtttgtcaactttgttgatctttttaaagattacctttaaaaaaatcacctttggttttacagattttctctactgtttttctattctctatctcaccagttttcactctaatcctattacttccttttccttttgagatgtttgttctttttccaatgacttaaggtagacgtttaggcaatttagatttatttaaaaatgtaggcatttatagctctaaagttccctctaagcacgctttagctgcatcccataagtttgatatatagtatcattttcatttgtctcaaaatatttccttttttttttttgatggaatctcactctgtcacccaggctgtagtgtgatctcggctcactgcaacctctgcctcgggggttcaagcaattttcctgcctggacctcctgaccttaagcgacccgcctcctcggcctcccaaagggctgggactacaggtgtgagccaccgcgcccggcctcaagacacttcctaattttgtttgtgatctcctgtttgacccactggttatttagaagtatactgcttaatttgcatgtatttattaatttcccaagtttgttatttatttctaactcaccccactgggatttgaggacatacttttgtacagttttaatccttttaaatttgctgaacttttttttaacagcctagcatatggtctgtcctggagaatgttcatgtgcacttgagaagaacgtgcattctgtagtagttgggtggagggttctacagttctctgttagtccttgttggtatacagtgttatttaagtcttctgtttccctgttgatcttctgcttagttttatccattattaaaagtagtatgttaaggtctccagctgttgtttttgaactactgctctcttccaatctgttagtttttgcttcatgtattttttgggggctgtttttggatgcatacatgtttataactgttgtatcttcttgatggtttcaccctgttattatcaaatatccctattttgctctgataacagtttttgttttaaagtctctccagcttttttggctgggtggtggtggctcatgcctgtaatcccagcactttgagaggccaaggcaggcagatcacctgaggccatctgagaccaacctggccaacatgctgaaaccccatctctactaaaaacacacacaaaaatgagctgggcgtgggctccccgcctgtaatcccaactacttgggaggctgaggcatcagaattgcttgaacccgggaggtggaggttgcagtgagctgatcgtgccactgcactccagcctgggtgacagagtgagactctgtccctccaactttttaaaagtacagcctctccagctttctcgtggatgctgcctgcatgatacatctttttctgtcctttactttcaacctattttatctctgaattgaaagtgtgttttctataggctgcatataactggatcttgttttctgatccaatataacaatctgtcttttgaatgaattgttaaatctattcacatttaatgttactattgataaggctggactgacttctgccatttaactttttgttttctgtatgtcttgtgtgtttttttgttcctctatatctcctttagtgtttcttttgattaatattttctagtataacattatatctccttcaattatttctttactatatttcccaagttactttctttttttttttttttttttttttttgagacagagtctcgctctgtcacccaggctggagtgcagtggcgcgatctcggttcactgcaagctccgcctcctgggttcacgccattctcctgcctcagcctccccagcagctgggactacaggcgcccgccaccacgcccagctaatttttttgtatttttagtagagacggggtttcaccacgttagccagggtggtctcgatctcctgacctcgtgatccgcccacctcagactcccaaagtgctgggattacaggcgtgagccaccgcgcccagccccaagttactttcttagaagttgctggctggcgcggtggctcatacccgtaatcccagcactttgggaggccaaggtgggtggaccacctgaggtcaggagatcgagaccagcctgactaacatggagaaaccccgtctctactaaaaatacaaaattagctgggcatggtggcacatgcctgtaatcccagctactagagaggctgaggtaggggaatcacttgaacccaggaggcggaggttgcggggagccaagatggtaccactgcacttcagcctgagtaacaagagcgaaactccatatcaaaaaaaaaaaaaaaaaaagaagttgcttaccacatacatcttaatcttttccagattttttttaaaaattagaaataaatatggaatgcatcaggaatttgcatgtcatccttgcacaggggccatgctaatctctgtactgttccaattttggaatatgtgttgctgaagcaagcattttcggatttattctaacttagagctccattccatcttcattctttttgtgctgtaattgtgcatattgtatctatgtatgttaaaagcccaacaatacttgttctaattgttactttaaataattttatgttagagaaactgagaaaaggaatgaagagcaagtatacatttatggagtttttatatttaccctcttattaccattttggttctcctcaccgattcctagggattcaagttgcaatttggtgtcatgatactccattacaactttggtaccacccgttttctttgtacagttattgcaaaatatgtttccatatgttataggttcaacaatataattagatggtttgtgtaagttttttaactgaagaaaaggagaagaaatatgcatttacacaatctcttacaattacagaattacctttacttaaggtgctctttgtttttcatgtggagtcaaattactgtctgaagtcacctgctttcaacctgaagaacttcctttggtatttctcataagtcggtatgctgcttaatttccagatgtttgtctgttactaatgagttctttcagtttttcttttctaagaatgtttttatttcaacttcatctttgaaacatagttttgtaaaatacaagattcttggttgactgttttctttcagcattctgaatatgtcaccctactgccttctgccttccattattcctgatgagcagtcagccactaatcttattggaatatccttgggcatgatgagccatttttctcttactactttcaagattttcttatctttcaggattttttttttttctttttggaggcagggtctcgctctgtcacccaggctgtgattgcagctcactacagcctcatcctcctgggttgaggtgattgtcccatctcagtctcctgagtagctgggattacaggtgtgcactactacccctggttaactttttttttttttttttttttttttcaaagagatggggttttgccacattccccaggctggtcttgaactcctgagctcaagcaatccacccttcttggcttcctaaagtgcagggattacaggtgtgcgccaacatgccaggcctcagcgtttttattaccatgtgtctgcatgtggatctgagtattccgacttggattctttgggcttcttgaatgtgtgcattaatgatttacattacatttgggagattttcagcattatttctttgataatttttctgttactttatctccttctggtactcccattatgcatatcttggtgtgcttaatagtgccccacattattttaaggccctgttttctttattctttcttccctctgttctttagaatgtttaatctctatcaacctattttgctgagtctttcttctgccagttcatatctactgctgagtctttctagtgattttttcatcttgattattatactacttaaaaaaaagttttttttgagacaaagtctcactttgtcacccaggcgcaactgcagtggcaccatctcagcacactgcaacctctgccccgggttcaatcgattctcatgcctcagcaatccaagtagctgggattccaggtgtgcaccaccatggccatctagcttttgtatttttaatagagatggggtttcgccatgttggcctggctgatgtcaaactcctggcctcaagtgctccgcccacctcagcctcccaaagtgctgggattacaggtgtgcaccaccatggccatctaacctttatatttttaatagagatggggttttgccatgttggcctggccaatcttgaactcctggcctcaaatgctctgcccgcctcagcctcccaaagtgctgggattacaggtgtgagccaccacacctggcctgattattatactactcttcaattctagaacttccactgggctcttttcaaatacttcctatctttttattgttattctctatttaacgacacattatcaaatagtcctttacttcttcaagcatagttttagttctttgatcttttttttttttttttttttttgagacagagtctcgcactgtcgcccaggctgaaatgcagtggcaggatctcggctcactgcaacctctgcctcccaggttctcgccattctcctgcctcaggcctccccagtagctgggactacaggcgcctgccaccacgcccagctaattttttgtatttttagtagagacggggtttcaccgtcttagccaggatagtctcgatctcctgacctcgtgatccgcccgcctcagcctcccaaagtgctgggattacaggtgtgagccaacgcgcccagccctttgatcatatttttaatggctgctgttaaatctggtatctggaccctttcacaggaaatttctgttgcctgctttttcttgtgtataggttacacttcctgttttttgtgtgtatgtctcaatttttgttaaaaactggacattttaggctgggtgtggtagctcacgcctgtaatcctagcactttgggaggccaaggtgggtggattgcctgagctcaggagttcaataccagcaactaggtaaaatcctttctctactaaaatacaaaaaattagccgggtgtggtggcatgcacctgtaaccccagctactcgggaggctgagagagaactgcttgaacatgggagacagaggttgcagtgagccgagattgtgccactgccctccaacctgggcgacaagagactccatctcaaaaaaggacattttaagtaatatactgtagcaactctggatactgattccccctccttcagggtttgttgttgttatttgcttatttattagtttagtgacttggttagactattttcgtaaagtctccttccccaaagactggtgaagattttcatgttgtgcctcagagagtgcaaccttgggcatgtacagagtctccctgggatgacattgagccaggctgtctttgactagctctttccatgatctctctgttaagctttctacctcttctggtatcacatccagctgttaggctctactaactgctgactgaattctcgactgtttttgataatgccctggagtatacactgctccaaagtctaattcaattaaattcaggaaggggtaatttttgaaattgagctttgttctgaccttgggagagttcttctcagctgtctccttccctggttctctggtgaactagctggcctgtagatcaccctgttcttaattaagaagagggtacctggccaggcacagtggctcatgcctataaacctggcactctgggaggccaaggagggtggatcacttgaggccaggagtttgagaccagcctgaccaacatggcaaaacccgtctctattcaaaaaagagaaaatataaaaaataaaagagtaaaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaaaaagagtaaaaaaaaagaagaggtacctctttttatttgcttaccatcaaaatctcctcaggcatgaacttccctggactctgttcttattaactgcctctctctgtgggcaaattctcagagcagggtcagtagcctctagtcttccgggcttgcctctcccagtgtaaaacctctgtacatgagcaagctagggcaaaggtgatcagagccatagaattcttggcctcaagtatgtgggatagagcttccacaccgtgagtacagtatggagctgggtggaggaaggaagcctctgacctctttgccatactcaccgagaacttagtctcttcaatttggagctggagggaagaagaaaagctgatggccccccactcccaatgagaaacctattccttgtttgggagctgagaattcctgggtttgtatattctgaacctgctggccagagtcaaatgctttaaggctgggcacctaaccaaagatgggccagagttctttaccaggaagctggagctgagactgggagtcttcttatttaataggcagtcttctgcctagtcccatcaaggggaccaggaaaaggtagggtacagtgagagagaagactaagaaacactgtagaaagaaaaagagacgaggagagaagtttctaggttcctaagaatgctctggttactggttcttgttagtccctgagacacagctgtctcaggtctgcaacaaagcccttctccctgaaatcaggtccactttggggagttcaatgaagtttctgtaacaagctgtcaaaagagtcttaatagtcatggtctagaattgccttgaggacaattctactctgagcaaatctcaaattaatccttcttggaaagaagagcaagaatggtcccaggcgcccaaggaaaagctcccgatcactcaggggacccatccttccataccttgattgtgctctgactcctcattggccactcgcatcagggcatctagcaccaaagcattgtctagccatgtgtaccactcttccaactcctgaaggaagctggctgtgcccgttgactctgacacctttcgagtcgccagtttgcaaagccgctcaacaaagccaggaatgctgagaagggccgctgccagggaaagaacaagcgaggaaattttcaaaatagagaccagcaaaactacccctaaagccctaacaaacaatctgcatgataggaataattcttactctgatagtagctaaagctactcttttaaaatgaatgtcaaaccaaggtaaatagtaattatgttacaggcataagctcagtttttagcaggtacagggaaacaggctttttatctactgggaatataaattagaataatctttatgccttaaatgtgtgtgtctttgagccaagaggtcaatttctgggaatttaccataacgaaataaccagtcatattacacgagaatatctgtataaggaggttcactgatgtggtttctgtaacagcaaaaaggtgaaggtaactaaatgttcatcaacagctgattaattaaatacaatgacacatttatacaatggaatactgcatagacactaagaatgatgacacatacatctttatatagtgactcaaaacagctgtttacttgttagagagtaaattattaaacaatatgaatttaattttcttcaaaaatttaaatatttgcttcttcaaaatacacaaggaatgaaagcatatataccaaggaatttactgtggctgttcctaagcaggagagaatacaaacaattctcttaaaattactcatctatagtttctaattttcctgtaacatttactagcaggatgaaagataaacatttttttaaggtaaagaaaaaaactgaataatcacccaatttttctttccaccaatctcattttattcacaatgagtgaggtggaaattctgatcggcatattagaacatcataaactttggaggcagggagatccagattcaaatcctgactccatcatttaaccttctttaaaatgagactaatgcctgatcatgtttgcctgtatatgcattaagtctccctggaaggacagaaaagaagccaagagcagtggctgccacagtaaacagccataagatggaaacagccaaaatgtccgtcaagtggaaaaggggatttaggtcactgagagtaacagtggaactgaaacttttcaataaatacctttttgaatccgcagattttttggaaccatgtgaatgttacacctaattaaaaattaataaataactagatatttcaggatatcaagggattactattaatttttgatacagtggcagttacgtttcttaaaagtcgttatcatgtagaaacactgaaatatatgcaggtgaaattatacgatgtctggggtttacttcaaaataacccaaggtgaagtagggtatagtgaatgggagtagagataaagtaagacaagctggccaggcacggtggctcatgcctgtaatcctagcactttgggaggccaaggtgggtggatcacttgaagctaggagtttaagaccagcctggtcaacatggcgaactccatctctaccaataatacaaaaattagccaggcgtggtatcgtgcgcctgtagtcccagctactcaggaggctgaggcatgagaattgcttgaacctgggatgcagaggttgcagtgagctgagactgcaccactgtactccagcctgggcaagagtgatactctgtctcaacgcgtgcgcacacaaacacacacacacacacacacccctcccataattagtgagtggctataagatgatgtttgaccttagttataaaataaaactacattgaggttcctcaaaaagttggccaggcacggtggctcacgcctgtaatcccagcactttgggaggccgaggcgggtggatcacaaggtcaggagatcgagaccatcctggctaacacggtgaaaccccatctctactaagaagtacaaaaaattagctgggcgcggtggcaggcgcctgtagtcccagctacttgggaggctaaggcaggagaatggcgtgaacccaggaggcagagcttgcagtgagcggagatcgcgccactgcactccggcctgggcgaaagagcgagactctgtctcaaaaaaaaaaaaaaaaaaaaaaagtcaaacataaaattaccatatgacccagcaatttcactcctacatatatacccaaaagaattgaaaacaggtgcacacacaaatatgtgtacacacatgttcatagcagcactattcccaacagccaaaagatgaaaatatcccaaatgtccattaactgaagggataaacaaactgtggtatctacatgatgagtattattcagccatataaaggaatgaagtactgacatgctacaacattaatgaaccacaaaaacattatgccaagtgaaagaaaccagattcagaaggccacatgctatatgattccatttacagttatgcactgcattaacgctgttgcggtcaacaacgaccacacagaagacggtggtgccatcagattataatactgtatttttactataccttttttctatgtttagatacacaaatacttaccattatggtacaactgcctactgtatttagtacagaaacatgctgtacaggtttgcagcctaagtgtatcatgggctataccagctaggtttgtgcaagtacactctatgacattcacacaatgacaaaatcacctcactgcatttctcagaaggatagagactgctaagtgacaacatgactgtatatgaagtaatctgaataggtaaatccacagagaaaaaagcagaatggtggttgccagcagttggggagaaggggtaatgggaagaagctgcttaatgtgtacggcgtttccttttggggtgatgaaaacgtgcaactagatagaggtggtagctgcacaacactgtaaatgtactaaatgccgctgagttgttcactttaagacggctaattttatgttacgtgacttccatctccataaaataattacacagaaatagatttttgtttgagacaccatttttttttttaacatatcagcttggcaaatataaaaaagtttgataatgctctgtactgggaaaggctacagacaacacggtggggaagatgaacaagtaatttctttggagggttaatttgtcaacacttaccaatttccattaatgggggactaattaaattacagtatgcctgtataatagaatattatataattacaaaaaggaatcatataattctatatatactagagtgtaatttttggcaagataagtttaataaaaagagagcagcacttattttatattacctatttacattaccatctgtacaaacaggagtcaatctctctctgtccctccctccttcccccgtcccatgattgggcatgtatagaatatttttcgaaggacgtttaagaaactggtaaaaagttaccacagggaggggaacaaactctctgctgtactttttgtatcatttaaaaaaaattttaggtgtgtattattttttctaaaaacaaatcagtaggcggggcatggtggcccatgcctgtaatcccagcactttgggaggccgaggtgggtggatcacctgagtttgggagttcaagaccagcctggccaatatggcaaaaccgatgtctactaaaaatacaaaaaaattagtcgggcctggtggcgcatgcctgtagtcccagctacttcgcagactgaggcacgagaatcgcttgaaccagaaagtggtggttgcagtaagccaagattgtgccactacactccagcctgggcaacatagccagactgtgtctcaaaataaaacaaagcaaaaaaaacaaaaaagaaataaaaagaatttgtattctacatgaaaatcttcacatagctggatttttactcttatacttctgttctcagcaaaaatagctcctgctgcttgacctgctcctctcaggacagcatgtaggagctagtcttccccattcctgcacactcaacacactcctccagatgggaagtgcccggtactcagggttctaagtctgacttcccacctgagattcttgagctgttgtgagtcactcacctcttgaaaagctaataaaagctaagaccttctccccagaaaaaaattcactggaccaatcatacctagcaactcatacacaatctcatgggctgacatcccagcatatccagtccttgtaattctcacagctttatcagtagctaccacacctggctggttaatgttaaactgacaactaaatcactcacaacccctgagaatttctgcagaagcaggcctcttctctcttctcactgttgaaacatcagtattccccccatactcctgtagtttcccctcctgctttccagcttcatgtgctgcataattcagcccctctcagctaagtgtcacttataaattgacaattatctagcctatagcttcatttacatctctgctaagaatcttgaaagacgttactttcccccagaaggaaaccagctgttctcttctaaatcgacagaagaacaactggtagttctgagaatctcaaaaaggactcaaaaaataattatttattttaaaatgaatctcaaaaaataatgacttacgctatcttcctggggctcagataatttacattagataattacatgtaaattatctgagccccaggaagatagtgtaaatcattatttttgctagacaagaaaatgacctcacagccacagtttattaaaaacgaaacgaaaactttttggcaacatcctacatatttcagctttccatacagttatggactgtgtccccaccccccgcgcccccacaaattcatacgttgaagctctagccctaaatatgactgcgttttgaaacaggccctttagggaatgcggtggtgtgatggttaattttagctgtcaacttgactggactatgggatgcctacatggctggcacagcactgtttctgggtgtgtctgtgaaggtgattccagaagagattggtgtatgagtgtgtgaactaagggaaaatctgccctcaatgtgggcaggcaccatccaattggtgggggagcagtgggaggcgatggaggaaaacaaaaagggattctcccccttctggagtgggaagtttttctcctactgctcttggatatcagactccaggatctttggcttttggtctctgagacttgcaccagcagtttctggggtcctccagccggggagctacaccattagctttcctggttctaagttttccggacttggactgagccatgctaatggcttctcaggttctccagcttgcagacggcttatcttttattttatttatttatttttggagacggagtttcactcgttgcccaggctggagtgcaatggcacaatctcagctcactgcaacctctgcctcctgggttcaagcaattctcctgcttcagcctcccaggttgttgggattacaggcgtgtcaccatgcccagctaatttttgtcgcagatggcttatcatgggactcctccgcctgtgatcgtgtgagccaattcccctaacaaatcccacctcataaatcctactgcttctgtctctctggagactgctgcctaatacagggaagtaattaaggttaaatgaggttacaaagtgtggggccctaaaccgagaggactggtgtccttctaagaagaggaagagacaccagagatctccgtctctcctcaatgacagagaggaaaattcatatgtggatacaataaaaaggtggccttctacaagccaggaagaaaggcctcaaccaggaaccaatcctgacagcaccttgatcttggacttctagcctccagaactgtgagaaaaataaatgtctgttagttaagccacctagtctacggtaccttgttatggcagctcaagctgactgatacacacacctgagataaaggcattcactactggagcgcaattcaagaatgataacattcagaggactaagactttcctcatccactcgtgatttaattatgtccaccagcttggccttcccagggcatttgaatggagaaaatcgtgcgggtaagggaatggagtaggaattatggtcagggttgggaagggtcagatcctgcacaacctcatgtgtggaactacaacttttaggctttatcccaaaagctacaagcagaatcacacatagactgtctactaggctagtcacacagatatgaaagtgaatctagattattttatagagactttaagaaaaaactcccaaataaaaaaacaaaaacaaaaactgggctttccgttctcagttaatcaaaaaagcccagctgaccagaacagttcattcctcaagaataatgggtaatgctggttttacttaagtcagtttacaaataggcatctgaaagcaatcaatactaacaggatcaaaatcatctgccagaatagattccttaaatgggaaactaaaagatgaaagttacttagtgcctcggcatacacaggcatccaatacagaacctttctagccctcagtttcctcacatgtgcaatggggatactaatctctattccacagggcacttgaaggattaaataaaatcacttctaggtaaagcagttacccagcgtttgccacataccaggagcttagcaaatactaccttttgtcaatgtatatggaggtgtgtacaccagctctgaggtataatttagttataatgaaagtcactttttttaaaattatactttaagttctagggtacatgtgcacaacgtgcaggtttgttacatatgtatatatgtgccatgttggaaagtcacatattttttaaaaatgtaaatttcctaaaatgagaactcccccaaaatcataaaggagtgggaagaaaaccgtacacagaccaaggaagaccttgtatctagtgacacaggaggaaaagcaaatctagagagagaataaactggggttggagtccacaaacttctacctttacatatgactacaacatgtaaaattatattccctaataacctacaaagtatagttatgatcacctcatgttcctaactaaaactagacaataacagagtgaatggcaggttcatattcagcctcaggagaggaggctgctctgaagcacttgataactctgcagagccagcctggggaatgcacacaactggactttagaaacaaagaactgttttcagagcatgattagggctacctctgcatggtcatggttttctactgctgctttttaatgatacatttgtataattttaccttgtttatttggtgtaccataaggtacacagtgataggtttttgtattaacaatatttccagcctgttaacattgaaaaactagcttttaagacacaagtttcagttcaaatatgaattatctacactcttatgaccaaaatacatctatgccagtttctccaaaatctgtgcaggcaacaacattttagatagaacacagttcttttgctactgaacagaaataggtgggctagattggttagaatagtgttttgtttttaagtaatatatttacacggttctaaaatcaaacaatatatgaaagtatacagtaaggagtcccactcccactgctactaccttcccttaccagctacttcctattaataaccactttatgtttcttgtgtaccctttgtttctttaggcataccatatatgtgggcaaacgtatggtcttattctccccctgacttaatacaaaaactataccatatacacactgttctgtattttcctctttatcattaatatatcttggagatttttctatagcagtacatagagatcttcattttttcaaagctacacaattttccattatataaatattgaatacactaagcagtccagtgttaatgaacatctgggtttctagtcttttgttattacaaataatgttgcaatgaataatttttttttttttttttgagacggagtctaattatgtcgcccaggctgaagtgcagtggtgcaatctgggctcacagcaacctctgcctcctgggttcaagcaattatcctgcctcagccttctgagtaactgggactacaggcgtgcaccaccacacccagctaatttttgtatttttagtagagatggggtttcgccatgttggccaggctggtctcaaactctgaacctcaagtgatcctcctgcctcggcctcccaaagtgctgggattacaggcgttaagccaccgtgcctggcctcagtgaataatcttgtacagtagtcctcccttagtcaagaccctcacagtggatacctgaaatggcagatagcaccaaaccctatatatactatgttttttcttatatacacacataactatgataaagcttaatttataaattaggtacactaagagattaacaataactaatgataaaatagaacaattgtaacaagatgctgtaataagagttatacgaatgtggtctctctctggaatttttcagttaatattttcggattgcagttgaccacggataactgaaaccacagaaagtgaaactgcagacaagaggagattagtgtctatacatcattatctataaaatgaaggcccaggagagacttagtagatcaaaaagtatatgcatttgtaattctgataaaaagtagttcttaactttttttgtggttctgagcccattaacaaatctaatgaaaggtatggaactcagttcccaaaataatgaacagatacacaaaatttacatactaggagccttcacatggatccatctctagagatatttaaaaggggtgctaggtgtggtggctcacacctgtaattctagcacttcgggaagatgaggtgggtggatcacttgagaccaggaagtcaagaccagcctgggcaacatggcgaaaccccatctctacaaaaaatacaaaaattagcccggtgtggtggcacctgcctatagttccagctactcaggtggctgaggtgggaggatcacctgagcctggggaggtcaaggctgcagtgagccacgattgtgccactgcactcctgcctgggtgacatagtgacgatcccatctcaaaaaaggaaaaaaaaaaaaaaagaaaagaaaagaaaaagaaaaaaaactagatgatttagtaagggcctcagagctataatctcaaaattctgagaacttggagactttaccttgattgatttcagctgcagaaggccccaaactcaagctcttcttctgttgagcatttttggcaagaagcgtgtgcttgtcatcattccctgtatccatctctgaaatggtgacagccagaatccggcagaaattagcgagctgctgctgatcgaaattggatactaaggaactcagattggggacttcatctagtcggatcatttcctacagaagacaaaaatgaaacaatccccatgctcaattcactcaagagattggatgtgcctctctttcgcatccccttacatacggggcttagtggctagatcacttaggttcctatcccagctctgtaacttgcagctctgaaactttggttaagttacaaaaacctttcgagtctttgcttgtttatctgtaaaacggaactaatctacctcacaggattagtctgaggactaaatttaccttttgagcaccactgttttcaattgttcttgtggtatattttgcctatttaaaaaaaaaggaaatgcctaccactcaagttttggaaatcataaattaccattcttgctacagatttgcttttttaaaaaataaaatacttcaaatatagctaaaggcctctgtgtatcccccatccagtcgcatttttttctctccctgcagacgtaaacattattttgaactctgtgtttattattcccgtgcatgtttttatacttacaaatatttccattaaaatacatgttactgctctgcatgcacagtgtgaatgataccatactataccttacttttcatccaacattttgaagtttatctacactgatacaagcagctgattcaatcacttcccgccgttttaccccacagtttaatcatctctctcttttaagagacagggtctcactctgttgctcaagctgcggagcagtagtgtcatcatagcttactgcagactcaaactcctaggcccaagcaatcctcctacctcagcttcccaagtagctaggactacaggtgcgtgtcattacacctggctacttttttaatatttttttttttgagatggtatctcattgtcgcccaggctggagtgcagtggcgcaatcttgactcactgcaaactccacctcctgggttcaagtgattctcctgcctcagcctcccaagtagtggggattacaggcgcccgccaccacgcctggctaatttttgtattttttagtagagatggggtttcaccatgttggccaggctggtcttgaactcctgacctcagatgatccatccaccttggcctcccaaagtgctgggattacaagcgtgagctaccacgcctggccaatactttatttttatggagacagggtctcactattgttgcccaggctggaactcctggactcaagcaatcctcccaccttggcctcctaaactgctgggattacatgtatgagccactgtgcctgaccctttcttcttttaatacatatttaggtaaactacagtttttcactattaaacaatgttgcaatgaacattcttacaggtactctctgtgtacacatgtatgtgaccatttatccagagtgagagcaagaattcttgtctttttcttgactttaccagaaataattccaaaacattaaaattaagttcaatatttgctgtaaattttaatatcctataagttaaattttaataaataccctatatatagtttataagttttccttctattgctagcttttattaagaatgataattttatggaatgccttgtgctatttggttctattctcactcattactccttaaaatctgtaaatggcatgtactacatcaacttttctcattttgaaccatccccgtgctactcagataacacctgctatccttcatcccactaatttacttccactggattgggtgtttctctttcactgcacagatcacatgaacttttaataatctgttcctgcatctatttcccaaataatctgaccatactttgatgaaggcatatatcctaccctttctcctgagactcaatgcacaggacctggtagcaagggtatcagtgaatgtgcccaaaacgagtgcatgattcctagaagctctcatgaatcccatactcgcctctatttctagtaatggaggacaggaatttgctgtgcagggggcattggggaacaactgcttccacttttccttttccctagtacaaaacaaatgtaagctactactattattggcaactgtaacttgtagctcaccagttcctctagccctgtctaactcagtatatggttcccaaaacaggtcccaccacccccagcccacttcttatggttttttgttttgtcttaaattttaagatttttttttttaaggcggagtctcactgtgatgcccaggccagagcgcaatggcacaatctctgctcactgcaacctctgcctcctgggttcaagcaatttttctgtcccagcctcccaagtagctgggactacaggcatgcaccaccatgctgggctaatttttatatttttagtagagacagggtttcaccctgttggccaggctggtctcctgacctcaagtgatctgcccacctcggcctcacaaagtgctgggattacaggcatgagagccactgtggctggccaagaatttacttcttatgttttaatttttgatatgtacaatacgtattatgcagcacaacaaaatgactagctgtgtgtgcctttcctattgcatctctctgcctctgggaaccaccatcattaattattattgccttgccatttaaaaactagttttatcaacaaataatttgcttttttgagctttatgaaaatgatatactacctacagtgttctgcaactggcttctaccactcgattatttcaattactcagctatgttgttgcctatggcaacagttcattcatttctactatataatattccattgtgtgaagaaagtacattcatcccttctcctattcatggatcagagacttggtttcagttttttgttctgaaacaacgaagctacaaatgttcttatgtgtttcttgatgcacaggtggagaagtttttgctggggcagtggcttctaaactttttagctatcaccaagaacgaccaccagtaaacatacatattggaatgtatatagaaatgtcaaacaaaaacttattcaaaaaatacccttacacaatacagtttgatcttttctacttggctggtagacccgatggactgactttacaaccttctgggtttcaatcctaagaatcactgttctaggactgagcttccccacaagtgtgtccaggcacaggttataggtaacccatggcaaaatactgatgcctcagccctcagggtaaagcttccctaggtgctggggcacaagatatgtgcctgttcaactacaaaacaaaaaaaaagaggatattctgctgataaacatttatcagtagtatacaagtgtttccactgatacacacactcaccaacatttgcccactctctccctcactatggtattgatttgcatttccttgattgccaatcaagttaaacatcttctcttttatgtttatggaccatttctttcttgtctgtgaaatgcttgttcataacattgcccatttgtctactgggctatttctctttttcatgctgatttgtaagaattctgtttttttttttttttttgagagggagtcttgctctgttgcccaggctggagtgcagtgacataatcttggctcactgcaacctctgcctcccgggttcaagcaattctcatgccttagcctcccaagtagctgggactacaggtgtgcaccaccatgcctggctaatttttgtattttttagtacaaaatgagactgggttttgccatgatggccaggctgttctcaaactcctgacctcaagagatctgcctgcctcagcctcccaaagtgttggaattacaggcatgagccaccgtgcctggcctgtaagaattattgataaattctgaatacaacaaatcctttgttggttacctgaattcaaatgtcttttcccagtttatggtgtttccactttctttatggtatctatccccctttcaaactgcaccaagatacccataatgtttggtggaacacctcgccattttggggtacacaaaaaggaatgagagggagtgagaggcaagtgggaaaagttgtgaaggagcacttctagactcctatgctgagactgctaaggagtctggagtttccactctggaggtcccctttcacacactggctggaacacacaattactggaataacaacaaagcctttttatcaaagggcacaaagggtctgtctggggcctgcacacatctccaatgtgttcctacagacaataggccacttgtgctgggcaatgacaagcaaggcctggggaaagcacagcaagaagaaatgaacgctgggttcaccacagtgcacatgaacatccacctccctgcaacagcaacctctaggaggctgctcaacaggaagagaaagaaatctgccaaccagcaaccaacatggaggctcaggacagattaggactggggaggtgagctccaggtcctaacaagcattacaccaaaaatgtaacacagtaagtctctaacagagatctatgaatgtatttttgggtatctgtgaattcttgaaatttttaatttagttttcatttcgatcatagctgtttttttttttttttaaagttatgggtcatccgaatattaaccttatgaccaagtggcaggatttcagagctcccatttgtctcctactgcgctggtgccaattaaccaactttaattgttgaagactaatgagaaaaaatagaggcggacttcataagtgaaagccaaacattactaccaaggagaacatatcctaatgaatgaaggcttcacaccagttcagatagcggtaaagtggtaagagaatggagtcactgcatagcatacaatagcacatacatgctacaaagaacttgccccaacggtgatgagtgaggggcaatttgatttcagcaaagtaacatgaggcatcaccctacattcacagagtcaatctgaagttctgagttttagaattagtttgatttcaatgtatgtctgtttaggttttacagtcatttaagaaccactagtataaggggtaatcaagttttatacttgaatacatctgagtaacaagacataatttaacactttcttttaaaaaagctctgtatattattcagttttgagaatccaatggtctgagacacccttccccatctggtcagctagaggacacagctcacctttttaacacccaaaatatcttcaatgagggttgctgtttgtaagaatgtcttcttacttgtcatcaatgtaaacaggaagatcacaaagtcattcttttctgccaaacgctttgtaactccctctgtctgtcacaagaagaaaaggcagaataggttgtaagtacaaaataaattatgaaagtacaaggcatcctttacagacactgaaaagcagtttcacctctgaaaactggcatgagtcaacaaaacaggaatggcatggcttaactgtgggaaacgctcgttaactccccagctatggaagaaaaaagtctcctgacgtgcaggctacacaagtgggaactcacttgtgagaacataacacaatgagatggtatttcctaaaataacttatctcagagttctgaaggccattcttaaatctgaaatcaaacagtgccgaagcatggacttaagagtcagacctaagttctaattccagctgtgtgatcctgagcaaatcacttctcacctttggaactccatttttttcatcagtaaaatgatcatcttaaaagtctttgaggccaggcgtggtggctcacacctgtaaccccagcactttgggaggccaaggtgggcagatcacttgaggccaggagttcgagaccagcctggccaacgtgccaaaaccctgtctactgaaaatataaatattagctgggtgtggtggtgcatgcctgtagtcctagctactcaggaggctgaggtaaaaggatcatttgagcccagaaggtggaggctgcagtgagcctagactgtgcaaatgcactctagccttggcaacagagggagaccctaactcaaaaaaaaaaacaaaacaaaaaaaccaacaacaacaaaaaaacaaaacccccaaggggtatgaaggaagttaaggaaactagctggtaaaagaccttaaaacttaggttcaagagtttggatttaaaactgcagtattgtcaagtgcagtggctcacacctgtaatcccagctaccccggaggctgaggtgagaggaccgcttgaggccaggagtgtgaggccgcagtgagctacaatctgtctcaccactgcattccagcatggggacagagtgaaaccctatctctaaaaagaaagaaactgcagtactgctatagcttacacacacacacacacacacacacacacacacacacatatatatcccacccctactgccttaaggcaactagagcttagtgactttaatatttcttttttttagcctctaagctgaaaaaattccaaggtttactgcgataaacttgacttctccttaaaaagtataatcaagagtgcagacacacacagtttggtaaatgggaaccccaagctaggaggcatttcagaatcagtgaaatgagatatgttgcaacaaatttaattttctttcttttaattttagagacagggtctcactctgttgcccaggctgaggccatgactattcacaagtacgaatatagctcactacagcctcaatcacctgggctcaagcgatccccccacctcagcctcctgaatcactgggactacaggcgtgcaccaccgcacctggcaaatttaattttcaaagtgaaggcatcaataaagatgtgccacgtatataaatctttgacgatcacattaaataggacactaaagaaagcaatctccatctgtattaatacatttcggttcttcagtcgtagcactgacacattaaaaaaaaaaaaaaaaaaggttgttattcccgaactacatacagtacctacactggctatgatatgtgaaacaggactgactctagttttactgacaagcaaaagttctggaagatccaaagaaacagaacaaaaagagaactaaatttacactttctcaaagcttaaaaatctatctccaggctgtcaaatacacaaccctgctgctctaactagctacccttgactacccacctttctcctctcttcaatttatcaaagtgctactccttttacagactgactaaaatgactcctcttggaaaaccttcccaagtcaacagtggccacccaaaaggccatcacaatccttcctttcctctatatcacaagttcttaactgaggccaaaaagcactaaaacaatatataaaaggttgtatgcaactacatttttcgggggagagttttttccatgtaacattcatcataggtttttttttggtttttttttttttttggagacagggtctcactctatagcccaggctgagtgagtacactggcacaatcatggctcaccgcagccttaacctctcaggctcaagcaatcctcccacctcagcctcctgaggagctgggactatggtatataacaccacgtccagccagttttttattttttgtagagacaggttctatgttgcccaggctggtcttgaactcctggacacacacaattctcctgcctcggcctatcaaagtgttgagattataggtgtgagccactgcgcccagcctaatcataagctcttgacctagtatctgtcaagtatctaaatgaggagctacaaactagcatccagtaggccaagctttttctggtgagcagtactgtttatttttttatcttttattttttgagagaccctcactctgtcacccacgctggagtgcagtggtgcaatctcagctcactgcaacctctgcctgctgggttcaagtgattctcttgcctctcctgagtagctgggactataggcatgtaccaccacacctggctaatttttgtgtttttagtacagacggggtttcaccatgttggccaggctggtctggaactcctgacctcaagtgatccacccgcctcagcctcccaaattgctgggattacaggtgatagccaccgtgcccggccaacagtactttttaaacttttgaattcaaacatctttagacaggacatacttgctccagtttagtcacagtttacacaagtccccactccaacaccagcaattccaaacatttcctgttttctgcctgatccctggaggcattggtgtttgcaaccctgagagccccaggttctctacattaacatggaattcagccagatagcacataattgaaccatatcgccctatgttcctcaaattttttaaaaaattttatttaaaaatacttttagttgatatataataaaggtacataatttcagggagcatataatttaatacattcgtataatttataaaaatcaaatcaatgtacttgggatagccatcagcttaaatacttgtcttttctttatgctaagaaccattcaaattctcttctagctattttgaaatgtaaaacagaacagaatattataaactaagtcacccttactgatttatctaacactaggtcttatttatcatcccatatatttgtacccattaatcaacttctcttcatacatttcatttttttaacttaactgttttattggaatgtcactgattaacattaggtatcatgattttaaaacggcctcataaaactagtgactatatggagttgccaaagatggagtcattatattatacactgtcttcttctataaggacaatttcttattggccttagttgcaagaactgtgcatttcctgaacaatttgaaattttatcttatagatctccctgtgcctatctctgtcattggctatacatggctaccgagcacttaaaaggtggccaggccaaactaagatgtgctctgggtgttcaaacaagaggaaagaaaaacaaaacacacacacacattggattttgagagctcaatacgaaaaacaagtaaatatctcattaataattaattatactgattacatgttagaatgacaatattcttgatacactgtgttaaacagaatttatcattaaaattaacttcaccacttcttcctacttttttctttaaaaaaatgtggctacaaggaaatttaaaataacccaagtggcttgcattatatttcaattgcacagcactattatagatgctgaattacgtaagtgttcaaacatattcccctatttgtgttggctgctaagaagcttgaagccaaatttgtgcccatccgtaatacagatgattttatggtcttcatttttatatcagcccaattcctggctatacgttatgtccccacctttatcttcttctttcttacctgcttctaagttcgtgatcttggtagattttgcatacacccacaagatgtcagaaatcttattttgaatgaggcaagaaatgaaatggagctaaatgtttttttttttttatttccacagcatacagggttcacatttataatagcgctcgtctcattctgccatgtattatgattcacagtttacacagtttatcataagtttctaaaagacaggtactgtatcttttaaaaactaacatttatatattgttttacaaagtgttttcacatctactatctcatttctcacaataaatctatgatgttaatacaactgctaactgcattctattggtaagaaactacggcttgggaggtgtactaagccaagggccagaacacaaaatcaggtcctaacactaagtgccatcctcttttgtttctaccagattgctttctttattcaccattcttcctggctcagtggtcaacctagtagagtcctgctcaatatatgggcggggcttctggttctcattttgttttctaacaaggaaaatgaagaaataggcataatggagttaaaatgagtcttaaaggtcacagtctgccaacacttgtcaccttttgacaagtgtccagtttctacttggacagctctaaggccaaaggagtttactacctgctgcagcagtcctggctcttaacaactgctacaaaattctgcctccccgtaatttctaccagttagtcctgattttcaggcacacataaaataagcccgattcccccactgtctgaaagcagctcttatgtctgccattctactcgaatattcccatcttaaacattgcagacctggtaggggagataaacagagccccagtggcaggggtacttacacagacacaggtattatacaggatactcaagcagtccttggacatttcatcacttactgaaagtgaaagggtaatgactggttatttttctcaatgaaaagatagtacaacagttaccacatttttttcagcataagaactgttataatcccctccaagatgattatttttcctttaatatacttcttccagcccctgtctaccaaaggttttcatagtgcccatcagaacctacaagcccatttgcatattgcttttggtttgatacagcagctgttttcttattatgctccacagtcttcataatttcaacctgttgttgtgccatcatttaataaagccattttcccttaatgtcttgcttaggatatatctaggatttgttttttttgttttttgtgttttttggctatttaagtagaccacaaatgaacaacttaatatatatgtgtatccttttcatgtttgtattaaactagttcctcaagatacattttcaaaagtagaactactagaatctaaagtataggcatcttttttttgttcatttgttttggttttttaaatgaggtcttactctgtcactcaggggcacaatcacagctcactgtagtctcgaactcctaggctcaagcaattttccctcctcaccctcccgagtggctaggactgcatgcgcgtgtaccacgcctggctaaaagttaaaagtataagcatctcaattgctcttgttataaatttccattgaaagttctactgcagcaaacaaaaataccatttttatcagactcattaactgagcatttctttttttgttgctgttatctgtgttgggcaaatggctcttaatgtctgatctattactaattcttataaagaaactactacttccctgtgagcaggaacaggaaagtagcataaaaacgaaacttaattttcatgagcccaaaaccaaaagatgatgaaactgagtatgaaccatggacaaagtgctttatttggcacttgcttctattttttaaaattgtttccattcactcctaagctgctaggaatgctaaaatgctaggtctccttctcagatcccaatgggcagccctgccaagctagcttgactagatgggttgtctcataatcctgagacaacgcagacgctctgcatcccttatcaccacctttcaacctactggggctctgtgattgatttatttaacgacttcagagcagggtgaaacactgctctgcatgtctcactatatatctcactatttctagatcctccatttttaaaaggaattgggattcactcattcatcaagtattgttcagcatctactctagagcagatacagtggtgagggaaaaaaagtctcagccttcatggaacctataaatctagtgggaagaagagagactaaacaagtgcaccaacaaataattacaatatgctacttgctatgagggtacatagagaacatgaaagaccaagttagaatacacagctgagacattaaaaatgaatataaatcctcttaataaccactactgcatgcacaaatgaggccttatacagtatgtcgtattggggtaaaaaaaaaatcttttaaattaaaaaaacgcaaagttggtaggagggcattcaccaaacattaactgaagtcatctctggcttttaacaccagagtaaagtgcattcacttttttattttaaattaaataccgaagctgggtgcggtggctcatgcctgtaatcccagcacttgggaggctgaggtgggcagatcacttgaggtcaggagttcgagaccagcctggtcaacatggtgaaaccccatctctactaaaaaaaaaaatacaaaaattagccgggtatggtggtgggcgcctgtaatcccagctacttgagagggtgaggcaggaaaatcacttgagctcaggaggcggaggttgcagtgagccaagatcatgccactgcactccagcctgggcaacagagcgagagactgtctcaaaaaaaaaaaaattgaatacctaaaaagaattatttgtaacgtgtaagttataaaaaataataatagaatattacccatatatctaccacccagcttaagaaatagtgcataccaaaacactctgactttttaccattcacaccctggtaatgcctgaactttttacaaagagcatgtatcacctttctaaaaaaaatagtttaaaaaaaataaaacagagtgatcttactctctcagctagttatatgtgagaaagaagaatttcccaaggaaacatagaagctggatcacaggactatcaaaagtacaaagatgcattctcttaacccagatctgaatttctacgcagtacagaatgaataaagacagctgcttagctgggggaggagagagcaacctgtagctaaatgtaagacatgtccttactattaagagttaggaagggaaggaagaaggcagctgctgggaactgccaccgtatcggcaggttggaaaacaaggaccagtagctaataggtatacttacttttcagtttctgtccccggatagagatcgtaggcctcataagaatttctacaagaagctataaaaaaaattagataaaatcttcaaaattaattcaaagtataacttataaaatgattttgccataaccattcatggcccatgtatctgtcacagtattacaagacccttttgttccaggaggcagttaaggttcagtaaggctcctgactgcagcaagtcaggagacccaggttctagtcccagcttggccacctacttgcccttctctggcctcagctttctcatttttgaaaagaagtattttagattaggtaatctctgggatctaatgcggctttaatttctgaaaagctgcagaacattattactatgattcttctgtttaaagaacatttgtaagtttattttaaaaggactcaaaagatacaccataaattgttaacactgatttctacaggtttgggggttatatgcatgtgttttttattttacatactttaatacaattttgcacaaactgtttaaaataagcatgtatttaaaaattcattctacggagagaaaggatagttgataaaagggtcaatccattagaaagatataacaactacaaatatgtatgtacctaacaatagagcccaaaaatacatgaaacaaaagctggcagaaatgaaggaaacagataatttaaaaataaaagttggacacgttaataactctgctttcaataatagacaactaggcagacgagcaaagaaatagaagacttgaacacaacgaacacatatattctaacagacatctacagaacactccatgcagcaagaacagagtatacattctactcaagtgcacatgaaacattctccaggacagatcaaatttcaggccactgaacaagcctcaataaatttaaaagcacttaaatcacatacagtatgttgtgtggccacaatggaatgaaattaaaatcagaacgaaatttgggaaattcatgaattatatggataattttaaaaacccatcctaaataataatgggccaaagaagaaaccacaaggggaagtataaagtatccaagaaggatgaaaataccaaaacttatgatgtagctaatggagtgctcagagggaaatttatagctgtaaatgcctatattaaaagaaaattcttttttttttttttttttttgagacagagtcttgctttgtctcccaggctggagtgcaatagccctatctcggctcactgcaacctccgcctcctgggttcaagcgattctcctgcctcagcctcagagtagcagggattacaggtgcctgccaccactcctggctactttgtgtatttttagtagaaacgaggttttgccatgttggccaggctggtcttgaactcctgacctcaggtgatctgcccaccttgacctcccaaagtgctgggattacaggcatgagccaccgcacccggccaaagaaaattgtttctaatcgataacctaatcttctaccttaagacactggaaaaagagcagactaaacccaaagcaagcaaaagggagaataagagttgaaacaaatgaaacagagaatagaaaataacagaaaatgaacaaaaccaaaagctggctctttgaagactggcaaattcttaactagactgaccaagaaaaaaggagagaggatacagattactatactcagaaataaaggagagggcattaccaccaaccttatggcaacaaaagtgattataaggaactactatgaacaactgtatgccaacaaattagatgacctagacgaaatggacacattcctagaaagacataaaactaaaaactgacttaagaagaaacagaggctgagcatggttgttcatgcctgtaatcccaagactctgggcggctgaggtgggaggactgattgaagccagaagattgagaccaccctggccaacacagcaagaccccatgtctctacaaataaaataaattagctgggcgtggtggtacgcctatagttccagctacttgggagactgaggcaggaggattacttgagcccagaaggttgaggctgcagtgagctatgatcatgccaatacactccagcctggatggcagggtgagactccatctctttaaaagaaaaaaaagaagaagaagaaggaagaagaagaaagaagaagaaataagaagaagaagaagaggaagaagactacgacgaagaagaagaagacgaagaagacgacgaagacaaagaagatgaagaagaaggcgaagacgaagacaaagatgaagacgaagaagatgaagacaaagaagacgaagatgaagatgaagaaaagatgaagaaaagacgaagacaaagatgaagatgaagaagacgaagacgaagaagacaaagacgaagaagacgaagaagaagaaaaaacagaacatctgaacagccctataacaagtagagactgacttagtgatttaaaaaaaaacaaacaaaaacaacaataacaaaaaactacccataaagaaaaaccttggacatgatggctccattggtgaacaatacaagacatttaaagaatgatcaattcttcacaaactcttccaaaaaacagaagagaaggaaacatttcccaactcattctttgaggcgagtattaccctgataccaaaaccaaacaaagacatcacaagaaaactacagatgagtatctcatgcatatatacacaaaaatcctgaaaaccctagcaaacaaaatccagacacatacaaaaaggattatactccacgcatgatggcttatgcctgtaatcccagcactttgagacgtcaaggcaggaggactacttaagcccaagagtatgcaaccagcctgggcaacatagtgagaccctgtctctacaaaaattaaaaccaaaaattagccaagcatggtagcatgctcctgtagtcccagctactcaggaggccgagataggaggctcgcttgagcccaggagaggctgcagtgagctgtgatcacaccactgcattccagcctgggtgacagagagaccttgtctccaaaaaaaaaaaaaaaaaaaaaaaaacaagaaaaggattatacaccatgacactatgacaaagtggaatttatcccaggaatgtaaggttggttcaacatatgaaaatcaatataatacaccatatcaatagaataaaggacaaaagccaaaagccacacggtcatctcaacagatgcagaaaaagcgtttggaaaaaaaaacccaaaacactttcatgataaaacaatcaacaaggaatagaagagaacttcttcagcctgataaagggcttttattaaaaaacccacagctagcatcacgcttaacagtgaagactaaatgctttcccattaagatgaggaaaaagacaaagatgtccactctcgccacttcaatttaacattgtactgagtgttctaaggcaactagagaaaaataaaaaaagaaattaaaggcacccaaattggaaaggaataagtaaaactaactatttacagatgtcacaatctagaatacagaaaattcctaaagaatccactcaaaaaaactattagagccaataagcaagagttcagcaagatttcacgatatgtgatcaatatacataaatcaactgtatttctaaaattgtagcaagaagcaaaaaaaactggaattatgaaaacaattccatttaaaggagcatcaaaaacagtaaaaacacttagaaataagtttaacaagtgcaagacttgtacaacaaaacatttttgaaagaaattaaagacaatctaaaaaaatggaaagctatcttgtagttcatggatcagaagatttaatattgttaagatgataatactccctaaattgacctacaaattcaatgcaatcactatcaaaatctcagctggcttctttgcagaaattggcaagctgatcctgaaattcacatgcaaatataagggatgcataacagccaaaacaatcttgatctgtaaatacaaaaataaacccgtgtctatgatcagttgatttttgacaaggttgccaagacaattcaatgatgaaagagtagttttttcaataagtggtgctgtgacaactggatagtcacatgcaaaagaatgaaactggacccctgcctcacatgataaacaaagtcaatgcaaatggatcaaagatctaaatgtaagatacaaaatataaaattctcagaagaatacataggtaaatctttgtgaccttggattaggaaatggtttcttagatgcacaccaatacccaagtaacaaaagataaaatgaacttcatcaaaattaaagactttgtgtttcaaaggacaccatcaagagagtgaaaagacagctacttaatgggggaaaatatttgcaaattacaaggaattagtatccagaaactaatacaactcaataataaaaagacaacccaatcaagaaatggagaaagcagatgaacagacatttctccaaaagtccaataataaacagatgatcaacattagtcatcagggaaatgcaaatcaaaaccacaatgagatacctcttcatacctactacgatggttataatgaaaaagacaaatagtaactattggcaaagatgtggagaaattagaaccttcatacactgctggtagatatgtaaaatggtgcagctgcttcagaaagcagtctggcagatccttaaaaattaaacagagttaccagcaactccacttctaggtatataccaagggaaattttttagtaagacaatctaatagaaaatgaaaacacgtccacctaaaaatttatatgccaatgttcatggcagcattattaatcatagcagattactaataatagccaaaagtgggaacaacccaaatgtccatcaactgatgaatggataaataagatgtggtctatccatacagtggaatatttcttgacaataaaaaggaatggagtattgatacacgttatgacacggattaaccttgagaacattatgttaagcaaaagaagccagtcacaaaagaccacgtattgttatgactccatttatgtgaaatgtccagaataattaaatctataaagacagaaagtagattagtggttgcctaaggatgtgggagggaggccttgggaggaaatggggagtggctactgaagaatatggtgtttcttttttggagtgatgaaaatgttttaaaatcaattgtggtgacagtggtatataactctgactatactaaaaaactgaattatatcttttaatatatcttttaaatgggtgacttgtatgacatgaattatatctcaataaagctattatttaaaacaataaaacacctcatgctcagttatagaagctagacataaaaagccacacagtggacgattctgttgatatgaaatatccgtaacaggtgatatggtttggctgtgtgccctcacccaaatctcaccttcaattgtaataatcctcatgtgtcaagggtgggaccaggtggaggtgactggatcatggaggcaggtcccccatgctgttctcgtgataacgagggagtctcatgagatctgatgattttataagtgtctggcatttcccctgcttgcactcactctgtcctgctgccctgtgaagaaggtgcctgcttctcctttgccttctgccatgattgtgagtttcctgaggcctcccaggccacatggaactgtgagtcaattaaacctccttcctttataaactacccagtctcaggtatttcttcattgcagcatgagaacggactgacagaacaggcatattatggacattatggatatttcacaacaggcataatacagacataaaatagattaacggctgccagagctggggagaaggggagatggggagtgactgctaatttgtacaagatttctttttggcgtgataaaaatgttctggttatcactgcacaatactgatgggtggttacaagaattaactttatgtaaattatatttcaataaagctgttattgctggggaggcagggtggctcgtgcctataatcccagctactgaagaaggtgaggcaggaagatcatttgagaccaggagttggagactgcctaaggaacaaagcaagacccccatatctctaacaaatattaaaaaattagccacgtgtgatggcatgaacctgtagtcccagctactcgggagactgaggcaggaggatcactagagcccaggggttcaaggctgcagtgagctaggatcgtaccactgcactccagcctgtgacacagtgcaactctatctctaaaatcatcccaacaatttttaaaagctgtaattaaaaaaaattctgttaaacaaattctaggttaatataaacagaaaaaaataaatgttagaaaggaatactcccgaatcttaacagtggttgaattttggtgacaagtcccaagacagtttttcacattttccttgacaaacaccttttccttttaaaatgagaaaaattaggacctttgttttccaaaaaagtccaattttcacttaaagcatttaaaaattatctatatgctgagaatatgactaagcccatatgtttaaagacattccctatatacgtatgtattttttattattgtttaaatcaagctaggagctaccccagaacaaaaagaaaaattcttccttagccccttctagctataggccaatacttaggcagcatgtccaagacacctcaagccaaatgaagaaggaagattccatagcattttttaaattaaaaagccagcaggcaaatctttgagactagacagttcagcttgagggtctgagaaagcctctgctcatctcaaaccagcaacaaatctttagaaagtaattcacatgccatgagattgctcgtggcatgaatgtgacactataattcaacatcctgaattaagagagatgtgttattttagcttaaagcagcagattaaaaataaaaatcctaaactactacaccacagattgtcaattctagagaagcactgggctcagctttctgcacatctgtatttattgttaactgcacttgcaggagggaaaagaaagaagtctcatgacttgaggcaacaatgaaaactgccctgaacatatgcctgctttgctttgtataatagagacctaaggtcatcctctagaaaaggtgaagtaattattatacagtatataaccattttatagcctgttttcatcatgaattttcccatattactataactttaacattatattaacaacttcataaaattcaacaaaatagatagaataaccattatcttctcctggtagatagtcattacaaataatgttacacctaacggtcttggtatacacaagctttatctcattttgacttacgtcttcatcagagtcacagaaatggaaacaacagggcaaaatgagtagtaatgtttaaagctctgaagtatactacaccaattcttctcaaaagagatcacattcatccaagtaagacgtaagatgctcaagtgcatagaatgtatttaaaataaattaacttcaaatggaagatagactatgtcagtgaataaaagttcctgaatgccaagcaatggcttacacctggcccacaattactgaaaagctggaagatttttacctacaaatctagatttcccataacctctcagggaaacactcaatgggagaggaagagtcatttcctccataaaagcaggcacacactctctagcccaaaacattccccatactcatttaatttatgcagatgagcttgctctgggtctgcttcactccacttagttacatacttcacatctgctttgtaaactctaagacacacttttcacagtcatgttatggatagggtcaggctgacaaggagtgatcccactgagctttgggcagcatgaccaagagaggcttactttgggttcttgctagttattagcagaggaagaaataacaagctgtttggaaaatactaccagcagcaggacagcaagagagttcactaacaaatgcacccaaactgaaggtcagtgaggtgcataattacttaagcaggagcccatgtttataaaatgactgggattcctggagaagctgccctaactcaaagcaggaaagaaaaacccccacaaaatcaagaacagttgatccaaagatgtccgaagatgggataggctcctactagagagccacatttccactgcaaatagacacaggctacagacctacattattatttttcctcccataaatacatcagttcttactaagtagatttcttgatgaaacaattcaaaagtaaagggtctcttgagctagccaagtaagtaaatgccctaggaccaccgacactgctgtggagagggaatgcggagcagcagttaaagaagaaaggctgtggctgatgccatgcatgcagatgtcacactcaatctttactttactggaaaatggtagctttaaacaaaaggaaactttaataattgaagtataacgtgataccgcataaagagtacaatttttttttttgagatggggtcttgctctgtcacccaggctgcagttcatggtgcgatctcggctcactgtagcctcaacctcccggactcaaccaatcctcccacccagcccccatcaagcaactgggactgcaggccatgtgctaccacaatcggctaatttttttaatttttagtagtgatggggttttgccgtgttgcccaggctggtctctaactcctcaactcatgcaatccgcctgcttcggcctcctaaagtgctgggattacaggcatgagtcactgtacctggccatgagtataaattgcacatgtagttttacacactgaacaccattcctgtacaatcgccacatagatcaagataaagactaaccataatacccagaaatgccctctccctcatgttcacttcaggtaatggggttaagggcagatatctaggggagcaaagtcagatcctaacccctcagtcattacaccaaaataaacttcaaatgatgcaaaaatttaaacatacacaataaaaactgtaaaatattagaaggaaataggcatggtttaaatccaacagtgggaaaggcatgaaccaaaactctgaagccattatagtaaaacactgatcaatctgacaatctaaaaattaaacatttctaattttaaaataacatcaaaatttaattctcaaaatagtaaaaaaacacaaatgacaaaggcctttaaaaaatcaaaagcacttacagatcaataagaaaaaggacaaataatcaaatcgaaaaaggtgcaaaacagaaaactggcagaaaaggaactacttataaacacaagaaaaaatatccaatctcagtcatagaagaatgaattttaaaaactatgcagagaatttataaagaactcttacaacacaatattcaaaagagatatatctcaactaagaaattgaaaaaggagagacagacatttctccaaggaagatatacaaatgacaaactcaagaataagatggtcatcattggcaatcagagaaattcaaatcaagaccacaatgagatgtctcttcacactcactagaatggctgtaatcattacagggctggagcgggggctcatgcttgtaatcccagcactttgggaggccaaggctgggggactgtttgagtccgggagtttgagaccagtctgggcaacaaagcaaaacgccatctcagtactttttttttaaattttaaaacactttcaaaatgacagataacaagtgttggcaaggatacagaaaaactgaaacccttatacactgctggtggcaatgtaaaatggcagggcctcttggaaaacattctggcagttcctcaaacaattaaacatagagttaccccatatgacccagcaactgtattcctaggtatgtatatgcctgagagaaatgaaaacatgtccacaaagaacctgtgcaagaatgtttatagcactgttattcataatagcaaaaagacggaggcaatccaaatgcctctcaacaaataaaaaatgtggcatatccacactgtgaaacatcatttgaccataaaaatgagtgttgatacatgctacaacacagatgaatctagaaatcattacgctaagtgaaaagaagccagtcacaaaagaccacatattatataactaaatttatacaaaacgtccacgacagagaaatctatagagacaaaaagtatactagtgtggggagagggggaggaggtggtagaggtaggggagtgctagataaaacacatggagtttcttttttgaggtgatgaaaatgctctaaagttgactgtggtgatggttgcacatatctgcaaatatactaagaaccactgaattgtgtacttcaaatgggtgaaatgtatggtatatgaaccatatcttaataaagctgattaaaaaaaactatggaaaaatatcacttttctcataactgcttagtaaatacttaaaatacactgtttgtggaagggggcttctgggtactggtaatgttctatttcctaatttgggtggtagtgcaaaagtgaatgtattttgtggtaattattggtgtacttttctgtatgaaggttatacttcagtaacaaagtctataaaaatacacacataaacacagtatgttggtgatggtatgggtaaacagacgctcatactttgttcctggggatataaactgacaaaacttcttaggtaggtaaacttcagatttataaacaataaaaaacatacgttcttgttccaaaggtatatactcacatgtatacaaaaatatgtaaaagatctttactgcaaccttgtctgtaagagaaatggtgtggaaaaattataaatgccagtcaactggggcctgggtaaataaattatggcacaatcacaccaggaaacactaaccatttaatttttttttgagagctcatcacccaggctagagtgcagtggtatgatcttggctcacggcaacctctgcctcccggcttcaagcaattctcctgcctcagcctcctgagtagctgggattacaagtgcctgccaccgtgcccatctaattttggtatttttagtagagacagggtttcaccatcttggacaggttggtctcgaactcctgacctcacgatccacctgccttggcctcccaaagtgctgggattacaggcgtgagccactgcgcccggcctaaaattgttttaattaaaaaaaaaaaaagaagaagaaagaaggtacagaatagtgtagccgtgtatatggtatatcactctatgtgcggagaaaataaactaaggtggaggtggtggggaatatttacacacacacacacacacacacacacacacacaaaaaaaacaaaacatcttaagcaggacacacaagaaactagtaatcacaactggttctgaggaggggacactgggaaatttagagatgtacttttcacttagtatttttttaaaaaggtatacaccaatttaaataaatgaattcttctgaagtaaaaactatgctgcttcaacatgtaaatgccgctaagcttctaaaagttaaaatctgaaatgttataaattctgaaatctttcctatctcccatttcaaaagttaaattcccaaaccattaagcagtagtaacagcagtagtaataataaatagctacttacatcaacacctccaaacaagtcaaaaatgtaagtatttggataagtggtttcttgggtaagtttcctctcttcagtaacaaatgccatagcctccatggagagaagaggagaaatttcctagtttttttaaaaaaaagtacatacattgttttagtaaccaacacagaccagacactaaagcatcagtttgagctttagtcccaactggagttcccatgaacacaaagacagtccccaatgaaccacacttcctagtattcaggcccctgtaaagccccttctcacactaaatctgggctggtatgacacacctcaactaacagcatgtggtagaagtgacactaggccacttccagcacaagccttaagaaagccaggctcacacctgtaatcccagcactttgggaggctaaggtgggcggattacttgaggccaggagtttgagaccagcctggccaacatggcaaaaccccatctctactaaaagtacaaaaattagccggatgtggtgctacacacctgtaatcccagctactcaggaatttgaagtacaagaagcacttgagccacggaggcagacgttgcagtgagccaacatagagccactgcactccagcctcggcaacagagggagactctgtcattaaaaaaaaataaaaagcctgacagacttcgctcttgccatcctggaacccaaacatcatgctgtgagaacacagccaatggggaggccataaggagaagaaatgaggccaagagcaacatccttagttgatctccagctgacagccagcaccaacctgccagggatgtgagagagaccattttggacattccagatatctcagtaccaccctacccaacagcacatgaagcagaggagccactcagtcaaccaagaattgttgacagataaatgattcttgttacttccggctgctaggtttcggggtgactagttctgtagcaataaccaagtcactgctcaaatataatctcctgcaggaagtcttcttgatttcccccaaccagaagcatgctcttcagacccccaaaacaatctacaactcatttgtaacatttagcacttttactttgcacctatttacaaaccatttctttttttttttttgagagggagtctcgctctgccacccaggctggagtgcagtggcgcgatctcggctcactgcaagctctgcctcccgggttcacgccattctcctgcctcagcctcccgagtagctgggactacaggcgcccgccactgcgcccggctaattttttgtattttcagtagagacggggtttcaccgtggtctccatctcctaaccttgtgatccacccgcctcggcctcccagagtgctgggattacaggcgtgagtcactgcgcccggccaaacctatgttatttcttccctagactaaacgttccttgaggacaacacaaacagatcccactttgtattccccacagattccaagacagagtatttgatacagcacacatagggtagtagttctcaaactgacggccacagaatcctttgttcatatggaacaaagctaagaggaaaaaaaatcttacaagaaaacctaaaacatagtaagtttcaaataagtacttacttaatgaataaagaaatgatgatcacatagcaaagatatacaaatattaatttccctcccctttaacttcacctcaatctcctgagattttgcaagaagcaaataatgtgcaactctttgaaaagcatttttaaacaagtttaagaagctataattatttctatcagactgtgagattcaaaatatgaaaatgtctcttcttaaacgtaaagactaagtttaattagtttctattacattttaaaataacttactatgtgatataataatcaaaacttcacctctgaagaacactgtcattcagtttcattacgttcaatataacttacatggtttttatttatttatttttgctgttttttattttattatactttaagttctagggtacttgtgcacaacatgcaggtttgttacatatgtatacatgtgccatgttggtgcgctgtacccattaactcgtcatttatattaggtatatctcctaatgctatccctcccccctccccccaccccatgccaggccctggtgtgtgacgttccccaccctgtgtccaagtgttctcattgctcaattcccacctatgagtgagaacacacggtgtttggttttctgtccttaacgatagtttgctcagaatgatggtttccagattcatccatgtccctacaaaggacatgaactcatcattttttatggctgcatagtactccatggtgtatatgtgccacattttcttaatccagcctaccattaaatggacatttgggttggttccaagtcttttgctattgtgaatagtgctgcaataaatatacacgtgcatgtgtctttatagcagcatgatttataatcctttgggtaaatacccagtaatgggatggctgggtcaaatggtatttctagttctagatccttgaggaatcgccacactgtcttccacaatggttgaactagtttacagtcccaccaacagtttaaaagtgttcctatttctccacatcctctccagcacctgttgtttcctgactttttaataatcgccattctaactagtgtgagatggtatctcattgtggttttgatttgcatttctctgatggccagtgatgatgagcattttttcctgtgtctgttggctgcataaacgtcttcttttgaaaagtgtctgttcatatccttcgcccagtttttgatggggctgtttgcttttttcttgtaaatttaagttctttgtagattctggatattagccctttgtcagatgggtagattgcaaaaattttctcccattccgtaggttgcctgttcactctgatggtagtttcttttgctatgcagaagctctttagtttaattagatcccatttgccaattctggcttttgttgccattgcttttggtgttttagtcatgaagtccttgcccgtgcctatggcctgaatagtattgcctagattttcttctagggtttttatggttttaggtctaacatttaagtctttaatcaatcttgaattaatttttgtataaagtgtaaggaaaggatccagtttcagctttctacatgtggctagccagttttcccagcactatttattaaatagggaatcctttccccatttcttgcttttgtcaggtttgtcaaagatcggacagttgtagatatgcggcattatttctgagggctctgttctgttccactggtctatatctctgttttggtaatagtaccatgctgttttggttacagtagccttgtagtatagtttgaagtcaggtagcgtgatgcctccagctttggttcttttggcttaggattgtcttggcaatgtgggctcttttttggttccatatgaactttaaagtagttttttccaattctgtgaagaaagtaattggtagcttgatggggatggcattgaatctatcaattacctcgggcaatatggccattttcacaatattgattcttcctattcatgagcatgggatgttcttccatttgtttgtgtcctcttttatttcattgagcagtggtttgtagttcttcttgaagaggtccttcacatcccttgtgagttggattcctaagtattttagtctctttgtagcaattgtgaatgggagttcactcatgatttggctgtctgttattggtgtataggaatgcttgcgacttttgcacattgattttgtatcctgagactttgctgaagctgctcatcagtttaagaggattttgggctgagacaatggggttttctaaatatacaatcatgtcatctgcaaacagggacaatttgacttcctcttttcctaattgaataccctttatttctttctcctgcctgacttccctggccaaaacttccgacactatgttgaataggagtgtgctgagagagggcacccctgtcttgtgccagttttcaaagggaatgcttccagtttttgcccattcagtatgatattggctgtgggtctgtcataaatagctcctattattttaagatacgtcccatcaatacctagtttattgagagttttcagcatgaagggctgttgaattttgtcgaaggccttttctgcacctattatcatgtggtttttgtctttggttctgtttatatgatggattacgtttattgatttgcatatgttgaaccagccttgtatcccagggatgaagccaacttgatcgtggtgaataagctttttgatgtgctgctggatttggtttgccagtattttattgaggatttttgcattgatgttcatcagggatattggtctaaaattctcttttgttatgtctctgccaggctttggtatcaggatgatgctggcctcataaaatgagttagggaggattccctctttttctattgattggaatagcttcagaaggaatggtaccagctcctctttgtacctctggtagaattcggctgtgaatccgtctggtcctggactttttttggttggtaggctattaattattgcctcaacttcagagcctgttattggtctattcagggattcattcaacttcttcccagtttagtcttgggagggtgtatgtgtccaggaatttatccatttcttctagattttctagtttatttccgtagaggtgtttatagtattctctgatggtagtttgtatttctgtgggattggtggtaatatcccctttatcattttttattgcatctatttgattcttctctcttttcttattagtcttgctagcggtctttcaattttgttgatcttttcgaaaaacgagcttctggattcattgattttttgaagggttttttgtgtctctatatccttcagtactgctctgatcttagttatttctcgccttctgctagcttttgaatgtgtttgctcttgcttttctagttcttttaattgtgatgttagggtgtcaattttagatctttccggctttctcttgtgtgcatttagtgctataaatttccctctacacactgctttaaatgtgtcccagagatcctggtatgtcatgtctttgttctcaatggtttcaaagaacacctttatttctgccttcatttcgttatgtacccagcagtcattcaggagcaggttgttcagtttccacgtagttgagtggttttgagtgagtttcttaatcctgagttctagtttgattgcactgttgtctgagagacagtttgttataatttctgttcttttacatttactaaggagtgctttacttccaactatgtggtcaattttggaataagtgcgacgtggcgctgagaagaatgtatattctgttgatttggggtggagagttctgtagatgtctattaggtccgcttggtgcagagctgagttcaattcctggatatccctgttaactttctgtctcgttgatctgtctaatgttgacagtggggtgttaaagtctcccattattattgtgtgggagtctaagtttctttgtaggacttgctttatgaacctgggtgctcctgtattgggtacatacatatttaggatagttaactcttcttgttgaattgatccctttaccattatgtaatggccttgtctcttttgatctttgttggtttaaagtctgttttatcagagactaggattgcaacccctgcttttttttttgttttccacttgcttggtagatcttcctccatccctttattttgagcctatgtgtgtctctgcatgtgagatgggtctcctgaatacagcacgctgatgggtctagactctttatccaatttgccagtctgtcttttaactggagcatttagcccatttacatttaaggttaattttgttatgtgtgaatttgatcctgtcattatgatgttagctggttattttgctcattagttgatgcagtttcttcctagcatcgaaggtctttacaatttggcatgtttttgcagtagttggtatcggttgttcctttccatgtttagcgcttccttcaggagctcttgtaaggcaggcctggtggtgacaaaatctctcagcatttgcttgtctgtaaaggattttacttctccttcacttatgaagcttagtttggctggatatgaaactctgggttgaaaattcttttctttaagaatgttgaatattggcccccactctcttctggcttgtagagtttctgccaagagaaccgctgttagtctgatgggcttccctttgtgggtaacccgacctttctctctggctgcccttaatattttttccttaatttcaactttggtgaatctgacaattatgtgtcttggagttcctctcctcgaggagtatctttgtggcgttctctgtatttcctgaatttgaatgttgacctgccttgctagattggggaagttctcctggataatatcctgaagagtgttttccaacttggttccattctccccgtcactttcaggtacaccaatcagacgtagatttggtcttttcacacagtcccatatttcttggaggctttgtttgtttctttttattcttttttctctaaacttctcttctcgcttcatttcattcatttgatcttcaatcactgataccctttcttccacttgatcgaattggctactgaagcttgtgcatgcgtcacgtagttttcgagccatggtgttcagctccatcaggtcatttaaggtcttttctatgctgtttattctagttagccattcgtctaatcttttgtcaaggtttttagcttctttatgatgggttcaaacatcctcctttagctcggagaagtttgttattactgatcatctgaagccttctctcaactcatcaaagtcattctccatccagctttgttccgttgctggtgaggagctgtgttcctttggaggagaagaggcgctctgatttttagaattttcagcttttctgctctggtttctccctatctttgtggttttatctacctttggtctttgatgatggtgacatacagatggggttttggtgtggatgtcctttctgtttgttagttttccttctaacagtcaggaccctcagctgcaggtctgtcagagtttgctggaggtccactccagaccctgtttgtctgggtatcaccagcagaggctgcagaacagcaaatattgcagaacggcaaatgctgctgcctgatcctttctctggaagcttcatctcagaggggcacccggctgtatgaggtgtcagtcggcccctactgggaggtgtctcccagttaggctactcaggggtcagggacccacttgaggaggcagtctgtctgttctcagatctcaaactctgtgctgggagaaccactactctcttcaaagctgtcagacagggacatttaaacctgcagaagtttctgctgccttttgttcagctatgccctgctcccagaggtggagtctacagaggcaggcaggtctccttgagctgcggtgggctccactcagttcgagcttcccggccgctttgtttacctacgcaagtctcagcagttgtggacacccctccccctgctttgctgccaccttgcagtttgatctcagactgctgtgctagcagtgagcaaggctccgtgggcatgggaccctccaagccaggcgcaggatataatctcctgctgtgccatttgctaaggccgttggaaaagtgcagttattagggtgggagtgtcccgattttctgggtaccatctgtcatggcttcccttggctaggaaagggaattcccccaccccttgcgactcccaggtgaggcaatgccccgccctgcttcagctcacactccgtggactgcacccactgtctgacaagccccagtgagatgaacccggtacctcagttggaaatgcaaaaatcacctgtcttaggcatcgctcatgctgggtaccatagactggagctgttcctatttggccatcctggaaccggacccccacttacatgggttttaactgcattagagctggtgctctaaattcaaatttagatccaaactacagctaaagtttagatactccagccctactgaatcagaatttcaggggtggggcccagaactctgtgttttaacacgctcttcaggtgattcataaacacactccagtttgagaacaattatcctagcataatgtctccgtgctctttccactcatttcccaatcatcaaacctggccccttcaatcttcttacgttagtaataatattcaacaaccataaggcctcttccacgagccttcagcagtatgtaatcttctaaacccttttcaaaaagaatgtcatcccaatcacaggatagtgttgacctcccaaaattaagcaagcactgccacaaaataaacacacatagagcccaaaaggataacacagggaacctaatggtgattatcttgggatgatgggattataggtgatgtatattttcttctttgtactttttctgaatttctcaaattttctatagctcacacagtaaaaacaggctatttttaaaagccaacggaagggaaaaaaaaaacagcagacatcttgtgtcacctagaggccctgaatacgcccctccaaggtccttaagagttaccttgaggatgttttgacactcaacaaagtcactgtggaggtggctggtggtgtgcagcttgaggagcagctgaggaattccactccacttggattgtttgtccctctccgtcaaaaaagtctcagtgaactgtgagtcaaaaaaagagagaacatattattgtattattgatgataatagctgatacggcaaaggagagcagccgacttccaaacccacccaggacagttacaaatttatctctaagcactactataaaaagcctctttctataaatcttcaaaacctccccaacagcctattactatgttataataagaaggagggattggaaatactcttgtaccactcacaaacagcacaatatcattgagagtggacttagactcgtcgtaaatatatactggaaattctagggcaactgctaaaagtatttttacaagaagaataattgatatgctaagagatgaaaaataatggaaccatataaactgctcagttaagcccataaaaggcagaaaaagaggggaagacaaagaacaagtataataaaacaaacatggtatacattaatccaactatatcaataatcactgtaaatatctatgaatggtctaaacttaccaatcaaaggaaagagactaaaagaatggatttaaaaaaccaagatccaacaatatgctgtctacaagaaactcatttaaatatacatatagataggttaaaagtaagggaaaaggccaggcacggtggctcacacctgtaatcccaacactttgggaagccgaggcaggtggatcacctgaagtcaggagtttgagaccagcctggctaacgtgataaaaccccatctctactaaaaatacaaaaattagctgagtgtggtggcaagtgcctgtaatcccagctactcgggaggctgaggcaggagaaccgcttgaactcgggaggcagaggttgcagtgagccaagatcgcgccatggcaccccagcctgggcgacagaccaaaactctgtctcaaaaaatagaaaaggggatggagaaagataaatcacataaaaagaaagatggagtagttatattaatttcagagaaagcaggcttcataaaaaaattatcagaaataaagtgggtcatttcataatgacaaaggggttaattctccaagaagacataacaatccttatcatatatgcacctaacaacagcatgtcaaaatatgaggcaaaaactgcctaaaagaactgccagacaaaaaaatggcaaatcaactcttacagttaaaatattttaaactaaatgaaaatataacttatcaaaatttgtgggatgcagcgaaagcagtaataagccagaagtgtatatcactgaatgcatataatagaaaagaagaaatatctatagtcaataatctaagcttctaccttagtaaactacagaaagagcagtttaagcctacagcaaacagaagaaaaaaataaaaatgagagcaaacatcactgaaattgaaaacaaaaaatcaagagagaaaacaaaaccaaaagttagttctttaaaaagatcaatacgattgataaactctaaccaggcttatcaagaaaaaaagacagaaacacaaattactaatatgtggtacataagaggagttattattactgactccatggacttcgaaggatgataaaggagtattatgaaccgtttgccccaatatttgcctagcactttgggaggctaaggcgggaggattgcttcagctcaggagttcaagaccagcctgagcaacatagcgagagctcgcctctactaaaaataaaaaaaaaaaataagccaagggtggtggtgcacacctctggtctcagctactcagaaggatgaggtgagaagatcacttgagcttgggagaatgaggcggcagtgagctatgacagcaccactgcactccagcctgggtgacagagcaagataaaaaaaaaaaaaaaaaaagacatcattataaccaaagagtgaaacaactcaaatgtccatcaactgatgaataaataaaatatagtatatccatccaatggaatattattcagcaaaaaaagtaatgatgtactgatactacaacaaggataaatcttgagaccattatgctaaatcaaagaagccagtgtctaactgggcacagtgtctcatgcctctgatgccaaagtaatcccagcactttgggaggccaaggtggacagatcacttgagctcacaagtacaagaccagcctgagcaacatggcgaaaccccacctctacaaaaaaaaaaaaaattagccggatgtagtggcacatgcctgtagtcccagctactcgggaggctgaggtgggagaatggcttgagcccaggaggcagaggttgcagtgagccaagactgcgccactgcacttcagcctgggcgataaagccagaccttgtctcaaaacagaaacaaaaacaaagcgagactccatctaaaaaaaaaaaaaaaaaaaaaacctaaaagaagccagtctcaaaaggccatatattgtctgattctattaatttaaaatgtccagaataagcatatccagagacagaaagatcactggttggcaaaggctgtggggatggggaaactggggagtaactgctactgaataccaggtttcttttttgggtgataaaatattctaaaattgatcgtgatgatagatgcataactttgtgcatacagtaaaaaccactgacttgtacacttcagttttttttttttttacccttttatctccttagtttaccaacttgtacactttaaaagggtgacttgtgcaatatgtgaattacatctcaataaagctgctataaaaactaaataaataaatgaacataagtgaactttttaggatgacaatgttctaaaaccagattgtggtgatggttgcataacttcatcaatttgctgaaaatcactgaactgtacacttacaatgggtaaattttattgtatataaatcatgcctcaataaagttgtttaagaaatatttaaaagaagaaagaagagaaaagggaacaaaggataggacattaaaaaagcatatattgtattaagcaagtataaacaccaaaatgtcagttattacattaaatctaaatatgctaaaatgctccaattaaaaacaaagtttgggccggttacagggcctcatgcatgttactgcagcactttgggaggcagagacagacagatcacttgagcccaggagttaaagaccagcctaggcaacacagtgaaaccctgtctctaccaaaggaaaaaaaaaaaaattaggcatggcagcatgtgcctgtaatcccagttactcaggtagctgaggcaggaggatcccttgatgctaggaggccgagactgcagtgacctgtgatctggtaccatactccagcccgggcaacagaatgcaaccctgtctcaaaaaataaatagaaaataaaataaaataaaaataaaataaaataaaataaaaacaaagtttgttatgccacctaccagagaaacagaaaggctaaaagtaaaagaatgggaaataatactcaatgtaaacatataccaaaaggtagtataactatattaaaatcagcaagagcaaagaaaaagcattaccaagccaggcatggtggctcacacctctaatcccagcactctgggagaccgagacaggtagatcacttaggtcaggagttcaagaccagactggccaacatgatgaaaccctgtctccactaaaaatgcaaaattagctgggcatggtggcacaggcctgtaatcccagttactcgagaggctgaggcaggagaattgcttgaacccaggaggtggaggttgcagtgagccaagaatgcaccattgcactccagcctgggtgacagagtgagactctgtctcaaaaacaaaacaaaacaaaaacaacaacaacaacaaagtactaccagagataggcactttaataaggataaaaatggcaaactggataatgttaatgatcctaaatttgaaaatatctaataaaaacttcaacatacataaagcaaaaactgacaaggctaaaaggagaaataaggaaatccataatcataatgggagattttacacatctctttcaaaaactgatatatgcagacaaaaattagtgagaatacagaatattttaacacaattaaacaaaatggacacacctcgagcagtatatctagtaaatgcactctacatgtcctttacaaatacaaatagaacatttgcaaaatgaccagctgctaggccatactgcaaatgtcaatacatttaaatgaactgaaatacagactatgttccacatcagaaagatagttataaaatccccatgtttggaaaataatatacttctcaaaaatgcatgggtcaaagaagaaatcgaagtggatatatgaaaatatcctgaaagataatgaaaatactacacatccaaactgatgaggtacaactaaagccatgcttactgaccattataaccctgataccaaaacctgtcaaaaggaaaactgcaggccagtttcactaacgacgatgtaagggaaaaaccacaattcaaaaattgaattaaatttaaaatttgtatcagaaattaaaagttggtttaatatttgaaaattttattcaatgcaattcaccacattgataacataaaggagaataattatttgataacataaaggagaataatgatatgaatacctcaattgatacagaaaaagcatttgataaaatttaacatccattcatgataaactcaaataaaaaaatgaatttctagtaacaggtatccacagaaaacccactgcaaacatcatacttaatggcaaaatgtttaaggttttttccctcttagatcaggaacatgctacttctattcatcatactggaggtctcaggcagcagagtaaggcaagatatatagaagacataagattggtaagggtaagataaaagattcatttgcagatgatataatattcacagatgactgtacagtatacaatccaaaagaacctaaatgtaaattatcaactattacagcaatatacatgaataatataaaaatctatcttatttttatattacagctacaatttttaaatgcagttttaaaaacactacttacaataccacttttaaaaacgctaaggaataaatctaacaaagttatgcaagacggctacatagaaaactgtaacacactcttggctgggcacagtggttcacacttgtaatcccagcactttgggaggctaaggtgggcagatcacctgagatcaagagtttgagtctagcctgaccaacatggtgaaaccccatctctactaaaaataccaaaaaaaaaaaaattagctgggcgtgatggtgggcgcctgtaatcccagctactaggggaggctgaggcaggagaatcgcttgaacctgggaggcggaggttgcagaaagctgagatggtgccactgcactacaatctgggagacagagcgagactccatctcaaaaaaaaaaaaaattacaggaaaataacttccaatttatacttctatacccagtcaaactaaatatatgtgtcagaataagacattttctgatctgcaagctttaaaaaaaaaaaaaaagttacctcccatgtactctttcttgggaggctaccagagagtgtgccccaggaaaaaggaagacaattgaggaaacaaggtctaaaacatgagaaaagaaagaaaaatgctctggatttggtgaagagaagtcccaagaactcagctgtatagcagacctagtaagcagctaaactaaactgctaaactgctaaactgcagtaggggaatgaagggcttcaaatgatttctttaaaaaaaaaaaaaagttttagaatttaggaacaaattataagtatacagaaagcaggccgggcgcggtggctcacacctgtaatcccagcactttgggaggccgaggtgggtggattacctgaggtcaggagttcgagaccagcctggccaacatagtgaaaccccatctctactaaaaatacaaaaaaattagccagacttggtggcgggcacctgtaatcccagctactcggggggcataggttgcagggagccgagattgcgccattccactccagccgggcaacagtgcgagactccgtcccaaaaaaaaaaaaggtatacacaaggcaaaacaatttaaaaggatgcattatacctgacttcaccaccatgcgatacaccaatgtagcaaaatttcacttgtaccccattaatacaaatttaaaaacagtaaaataaattaaaggatgcactattatgctaatgaaagtcaaaagggtatatgtatatatgtgtgtatatatgtatatatgtgtatatatgtatatatctatatatgtatatacgtatatatgtgtatatatgtatatatgtatatgtatatatgtttatatgcatatatgtgtatatgtatatatgtttatatgcatatatgtgtatatgtatatatgtttatatgcatatatgtgtatatgtatgtatgtttatatgcatatatgtgtatatgtatatatgtttatatgcatatatgtgtatatgtatatatgtttatatgcatatatgtgtatatgtatatatgtttatatgcatatatatgtatatgtatatatatacagggtatatgtatatttatccttcaatttaaaaaatggaagaggactgtttttaacactacaaaaaaattatataaaacaaatataattgtacaatatatggccctgctgtaaataataatgctaacatcataatgtaaatacttaacaacagccaaagctgtgatataactacattggtagactagtggagacgagtaagaaggaatcgaatgtgtgaattaaatcctagtctttcaagagcgaagaaaatagatagtatctaaaagtgaaaagaaacagctttataaccatgttatttagaaatactggctctcctgtttcctggatccttctcttgcaaaagaaatagctaagtatggacactgaacagcattaggagtatggaacttagaggtgcaaagcaggcagggcactgctgtttttttgttacaagctccatgatacgcagagatctaatcacagtccaaatatttgacttcacaagcaatttctttactatttatacattgtcttacaaggcatgtactctcatttaaaaataataatttggggctgggcacagcggcttacactcatatcctagcacttgggaggccaaggtaggcccattgcttgatcccaggagtttaagaccagcctgggcaacatggcagaaccttatctctacaaaaaaatacaaaaatgagctgcgtatggtggcatgcgcctatagtcccagatactcgggaggctgaggtgggaggattgcttgagcccaggaggcggaggtttcagtagttttttttcaccactacactccagcctgggcaacagagcaagaccctgtctaaaaaaaaaaaaaaaaatcattagaattttgttttccttgtgaacagctcagcactgtgacaaaagtgccaccattcagtcatcttcccagttgaattactggcaggtatcacatgggttttctcttgaagtacttgtggtttaacagtttacagcagtgataatctcttacatcataccctctaaactgtcaacctgtttagcaaatatgacatttctagacatttacagtttccactgattttattgtttttaaaaataactaaaggctaaattccatgaagataactgtgcatcttatttgtttctttaatcctaaatgtaagacatctaatgcctcaaaataccacactaaatgcaagggtctcgcgcaatctcactgcaacctccgtctcctgggctcaagtgatcctcccacctcagccctgcccccttccccctcccagccccccacaccaccaccactgccaccaagtagctgggattacaggcacgcaccaccacgcccggataattttttgtatttttagtaaagatggagtttcacccatcttgcccaggttggtcttgaactcctgagcttaaagaatccgtctagctcggcctcccaaagtgctagaattacaggtgtgagccaccgcacccagcctaaatagatatcttaaaggataataaagataaaataccttgttgggttattctgacaatacatgttaaccactgaatacttttgtgtcctttaatggggtatgattcagtaaaattaggagcaaatttaagggcttgtgaatacgaaaacttcccattgaaatgaatggcatatgtgtgtgtgtgtgtgtgtgtgtgtgtgtgtgtgtgtgtgtgtgtatgtgtgtgtatatatatatgtgtatatatatgtgtgtgtgtgtatatatgtgtgtgtgtgtgtgtgtgtgtgtgtgtgtgtgtgtgtgtgtgtgtgtgtatatatatatgaataagactttatcctaatcaggagtttttcagtatcaaattacctttgaaaagccaggtaagatttgtttgacttaaatgcctaggtttcataaatactaatggttagaatgaggctaaaacaagtagtgcctaatgaaattttttttaaaagttagtgaatctggctgggcacggcgactcacatctgtaatcccagcactttgggaggctgaggtgggtggatcaagagatcaagagtttgagaccagcctagccagcatggtgaaaccctgtctttactaaaaatacaaaaagtagccgggcatggtggcacatgcctatagtcccagctactcaggaggctgaggcaggggaatcgcttgaacccgggaagcggaggttgcagtgagccgagactgtgcactgcactccagcctgggcaacagcacgagactccatctcacaaaaaaaagaagtcagccaggcgcagtggctcacacctgtaatcccagcaccttgggaggccgaggtgggcggatcatgaggtcaggagatcgagaccatcctggctaacacggtgaaaccccgtctctactaaaaatacaaaaaaaaaaaaaaaattagccaggcgtggtggcgggcacctgtagtcccagctactcgggaggctgaggcaggagaatggcatgaacctgggaggcggagcttgcagtgagctgagattgcaccattgccctccagcctgggcaacagagcgagactccatctcaaaaaaaaaaaaaaagtcagtgaatctaaagaaaaaatataaagtaaggaacactcaggggcatttagatatgccaataatcataaaggaagcaacgactgccatgtgggaaatataacagcatcccacaacccagtctgtcaccagattgccaaactgaagggcatccagggatggcgggtcatgacctgtaatgtgagctgcactatcctagagcccagcgtttactcagtctatcctttccttcaactcgtactgatcatttggggccttgtacgcccatggtaaggaatccagaattgattctatcaactgcaatgagatgaggctggagagttttaagcaaaggatttataagatctgatttgcattaagcatcaaatgtgctgatgaatatgaaaaggctcagtaaactccaaagtatcaccccagcatattttattgccttgacagagggcagaacaaaacgaagggaagaaaataaagcaaactaaaatccaagtagaattgacccattacaaattatgtggccagtagtcatgactcaggcttcccttatgccccatttagggagatggagaagatcaggtctgatggaaaagggagaggattttggctttcgacatactaagtttgagatgcccattagacatcaaagtggaaatgctagaaggcaattggatatacctacccatccagagctaaaaggagaaacacgaatggaaacagaaacttaggatccgtcagcgtatagagcagttattaataacaatacaagctaatctttatagcagtaagctatgtacttatagctgagaaagtatgtttcagtcactattttaagtgctttatatgtacaactcacttggtcctcaccacaaccttggaaggtcaggtcctatgatacttactttacaaataaataaactgaggcataaacagattaaataacttgcctaaagacacatagtaagtaaataccagagctaggtttcaaacctaggtaatctgactctggaactctttaaagccatgagattgcttggcaagtacagacagaaattagactgaggacacagtatttcaatttaagcaatttcctgaatatcaaatggctggcaaggtttcaggctctgcagatacaatgaaaaataagacacagtctcttcaggaagcccagtctaattaactactagctgagagcaactatttactaaacaactattcctatatgccacactggctacgcttttaaaacatattatttcacttaatcctcctaacaactttatgggatagatgttatcatcacctctttagaaataaggaaactgaagttaagagaggttaaataacttaatcttggtcaccctgctaggattcaattcaggtccaccttactttaaaatctgatttttttttccaaggaaattccatcacatgctataccacagatgatccttgaggacattatgttaagtaaaataagccagtcacaaaaagacaaatactgtattactatactggggttatctaaagtagtcaaactcacaaaaacagaaaggagaagaatggttaccaaggactgggagggagaaatgggaagttgttcaatggtagtttcagatttgcaagatgaaaaagttctggaaatctgtttcacaacaatgggaatatacttcacattacttaactatacaccttttttttttaagatacagggtttcaccatgttgcccaggctggtctcaaactcctgggctcaaacaatccgctcacctcagcttcccaaagtgttgggattacaggtgtaagccaccacactgggcctgacctatacacttataaatggttaagatggtaaattttatgtttacatatatatatttatatatgtatatagtttgaggcagggtctcattctgttgcccaggctgcagtgtaatggtgtgatcatggctcactgcagccttgacttgccaggctcaagcgatcttcccacctcgggttcctgagcagctgggactacaggcatgcatttccacacctggttaatgttttttttttttttttttgtagtagagctggggctccaccacactgcccaggcttgactcaaactggctcaggtgatcatcccatcttggtctcccaaagtgctgggattacacacatgagccaatgtacctggcctatattatatatttgtttactacaatgaaaaaattttggctaggcgcagtggctcacacctgtaatcccagcactttgggaggacaaggcagggggatcatgacgtcaggagttggagaccagcctgaccgacatggtgaaaccccatctctactaaaaatacaaaaagtagccaggtgtggtggcacacgactgtaatcccagctactcaggaggctgaggcagaattgcttgaatccgggagacggaggatgcagtgaaccgagattgcgccactgcactccagtctgggcaacagagcgagactccgtctaaaaaataaaaaataaaaaatgtttaaatctggtcttttcctactataccacatgccataacagtataaaaatatgggtaatctgggcaacagagcaaaaccctgtctctaccaaagatacaaaaattaatggggtgtggtggcacacgcctgtagtcccagctactagggaggctaaggtgggaggatcacttgagcccaggaagttgagcttgccactgcactccagcctgggtgacagagcaagattctgtctcaaaaaaaaaaaagggtaagcaaataacttattctgcaggatgggagagaggagcggaagggcacagcatggaataaattaaaaaaaaaaaaaactaagaaaagaaatatttgaaagatgaaggtccccattttatcctcactatagctccaggcagggggtctctacttcaacttctgaaatagctcccacacctatatacaaccatcagttaccacaataacctgccttgcttttgtggctccagaatattccagcagccttgtatctggtgagctttttttttttttttttgagatgaagtctcactatgtcacccaggctggagtgcagtggcgtgatctcagctcacaacctccacctcccaggttcaagcaattctcctgcctcagcctccagagtagctgggattacaggtgcttaccaccacgcccggctaatttttgtatttttagtagagacggggcttcgccatgttggccaggctggtctcaaactcctgacctcagatgatccacccgcctcgacctcccaaagcactgggattacaggaatgagccactgtgcccagcctctggtgggcttttctaggctcctcccattctaagtcattcagcactggaaacaaattaagttgcctaaattgcctcatttatcatgctaaagaacttctgtggctccctattattctcagaacactgattatcaggatgggtgtttaggaacatatcatctaacctctctgagcctcagtttcctcatccatattaagaaatgagtcttgaagcataactcaaaagcttgaggattaaagataacatatgccttgtaccgtactttttctaaaggttatgtgctcactaaaagttagtcctctttctgcctgtctctacacacccagctcggtaaggtatcttagcttaagaaggaaagagcaagtatttctaggatttttttttttttttgagacagggtctcactctgtcaatctccgcctcccaggctcaggtaatcctcccacctcagcctccccacaggcacacaccaccaccatgcccggctaaatttttggagacacaggattttgccgtgttgcctgggctggtctcgaattcctggattcaagcgatctgcctgcctcggcctcccaaagtgctgggattacagggtcttaagtcaggtcttaagaacacaagggggaaaaaggctgctcatctatggttgtgtgatggccaggaaaacatttctcactcacaactgctcctttcgtccacagtcctccatacacacagaccccctagcctttattttattctatccttttcgtcatttgaggaagtgatattcaaattaaatttaaataaagttacactgtgaaaagtctcactcccattttctccccctttagcccaattcccacctcactcccaccaaccactttatcagtttcttgagtatccttcaaactttttatgaaaaagctgtctttaaataaagctaatgttttacaggtgttagcaaggttcggggtgggggagggtggaagaagtagtggactaggtcctattcaacctggtttaccctaaagcagtgtccttcgctcactcaaaaataacaataatcatatgttgggcacctgttataagtcagatgcttaatattaactaccttcagcccttagtatgcaccagaaatgcactaatgctttacacaattgccccctttgatctccacaacaatcttaaaaggtaggttactaattctcatcttcatcttacaagtgaggaaactgaggcacagaaaggtcacctgcccaagcaagagagaggagcagggctttgaacccaggcctgactccagagtccctcttaaccgtgacgctctacactagcaaaccagatatagtctctgcacccgctggaactcagcctaatgtgggagacgggcgagaaaaaggcagacaacaaagaaatacgaaattatagactaagaaagtaatgtaaacgaaacgaattcgcggctgtgacagaataacaatggggacctactttagaaaggggaaggaaagagtgtcaaggaaaggcctgagaaaatgacatttatgaaatgctcgggaaccatttgggggctgcaatgatgaccccctcccccacgcccaatacacgggataaactcgaggcccacagaggctaaaacaaacacgacagggtcccccagacgtgtagacgtggcgcaaagaagggaggatccagaaactgggcccagggttcgtacacgccatcagtgtccacagcagcccagccccgctcggcccctgacaagggacatcaagccagctgcttcccacggccccgctgcagctgagagcgtccgggcagctcacagggaggccttccggccagccaaaagggctttggcccgtccagcggcggcctggaaaggcctcttccccggccccccgccagctcccgcctggtccgccccgccccgcccctcctggtccagcctcgtacctgcaccgcccggaccaggccccggccggtcagctggccctgccgcagctgcagcagaatgttaccaggccgcggccggccgccccatccgccccaagccgccactgtggctgccgaccgtctccctcggccggctccagacccagccgctaccggcgccgccgccatgtctcctcgtcggacaaacaggaagcaagcggcctcggggccgcggagatttctacggggcggcggaggggtcgccgcagcgcccccagtgggccgtcggcggaggcgcaagccgcgtggcagggaccgtgtgcggcgtggaggctactgggaattgtagtcctgcgcggcagcggggtaggtgggaaaagagatgtggcctttcctgcactgccggtttctctggcccccgggcccagcatttcggcgaaatctcccaaggtccacattctcccatttctctcgccgatttgggcaggatgcaggcagctggccaagaaatgatcctgggcttcaggtcaggagtcaggccctcgagtccgcttcctgcctgcttctctctacacgtgactcaccgcggacatcgaccaagtcatcgcgctctgccactgcgcctgtgtcctcgtcaggtcactccatctatagattctgggagcctgatcaatcgtagttcctggggctttctctgcgcccgacaccaaaccatgtctaggggaaagggagggtgtctgggatacagtggtgagcagaacggcctgggatcctttatcacgaaatgcaggttacaggggaagacagcagatccatacacaaagaaacgcagtctcaaactggataagttgtgtaactgggtaggttgttgtgaaattaaataatggaagggaaagggattagtaaattgtgacatcatattctctgtcagatgaaaaccctgtcctaatttctatccaccagatagcatgttgtctctaatactcattttttcagctaacttctgtggcaggatggcactgactccccccacccaacacacacacactttttcccttcctagcagggggcctgtaataaaaatgaaagaggagagctaagtgtgatgtaacagggaatggtgaagattgtgactcataactaagatgactgtaacttactgctcaaaccagaacactttaaagaatgaaaagacacaataaataattacaccgggacggtaggcataaaagtgactctcccaggtgaactggcactatggttaccatcctcacaccccatctaaaaggagtagactcaccatccatcttcatagaactagaaaaaagaatcctaaaaatcatatggaaccaaaaaagagcctgcatgtccaaagcaagactaagcaaaaagaataaatctggaggcatcacattacctgacttcaatctatacaataaggccatagtcacccaaacagcatggtactggtataaaaataggcacatagaccaatggaacagaatagagaacacagtataaaaccaaatacttatagccaactgatcttcgataaagcaaacaaaaacataaagtggggaaaggacaccctattcaacagctggtgataactggcaagccacatgcagaagaatgaaactggatcctcatctctcacattatacaaaaataaactcagccgggtgcagtggctcacacctgtaatcccagtggctcacacctgtaatcccagcactttgggaggccgaggtagtcagatcatgaggtcaggagttcgagaccagcctggccaacatggtgaaaccccatctctactaaaaatgcaaaaattagctgggcgtggtggcatgcacctgtagtcccagctacttgggaggctgaggcaggagaatcacttgaaccctggagacagaggtcacagtgagccgagatcacgccactgcactccagtttgatgacaggatgagactccatctcagaaaaaaaaaaaaaaatagccaaagaagttacagtcaggagatattttgttccctatagaaactgaatataacatcttaaaatttgtccctgagtgttgtttcttagaaactcgaacccccaccaaatggatctgctgataggcaaactcagataagggagagctgagaactaaactttgacttctattttttgttataaatttcttcctagggggcctggaggaggacacgaccataagtcagagctaacattcttttctgcagatcccaaatttttagacaaagctttacctccttaaccaattacaagtcagaaaatctttgaatccacttgtgggcccctggttggagatgtcctgtctttttaggtggaaccaatatacagcccctatgtattgatttatgacttcgcctgtggcctctgccctcctgccattaaaaacctgtaagccggctgggcgcggtggctcacacctataatcccagcactttgggtggccgaggcaggtggatcacctgaggtcaggagttcgagaccagcctgaccaaaacggcaaaaccccgtctctactaaagatacaaaaattagccaggcatggtggcacgtgcctgtaatcccagctactcgggaagctgaggcaggagaatcgcttgaacccaggaggcagaggttgcagtgagctgagattgcaccactgcactccagcctgggcgacagagcaagactctgtctcaaaaaaataaaataaaacccctgtaagccataagggagttcaggtcttaagcataagctgtttgattctcctcgcttggcaccctgcagcaagtgcaataataaatgcctcactttctcttgctgtaatcccaatgtcagtggctttgctgcaccaggtaagcagccctcactttggttcaataacaatacttttcataactttttgcaccagctatgtatcatttctagattcaagaaaaaaaagtcttctaatatgtgaaattaactttaaaaagacataaaaagaaaaggcatttccagggatacaaacagggcattggtgagctgtccgggcagcagccagccttaccagggaatccacagcccagggattccacccagagctcttcctgaggcatatggtgatggatattctcacccttgtcgcggtgaggagacaggatcctgactaatttcacagttcacatggccctccaggtttcccttggcactcatcatgctagggacaaatcttcccacctcagctttgacccaactgcaaatgtcactttccattcctcagttcctatctttgtcagtctagcctggcccaggcattcaccaaagctgggtattcactgggtcaaaaatgacaacctcaaattcagtccttacagataccatgtgaccatgaagtaaggggacatgtttccagaaacctctgtggaaagacactcttttccacttcacctctgctctgccagccttttccgtagaaactagctgaggctaggcgcggtggctcaggcctgtaatcccagcacttttggaggccgaggcgggcagatcacgaggtcaggagttcgagaccagcctggtcaatatggtgaaaccccgtctctaccaaaaacacaaaaattagctgggcggggtgaagcgcgcctgtagtcccagctgccctggaggctgaggcaggagaattgcttgaacccgggaggcggagtttgcagtgagccgagatcgcgccactgcactccagcctgggccacagagcaagactctgtctcaaaaaaaaaaaaaaaaagctgagtgtctctcaccaccagagggcgaagtacctctcccaccagaggtctgttgatgtcaattttaatcagcactagaaaaaaaatgaagctcccaaactggctaattttttttccaccgtaatcccaaatggcttaaccaaacatgatgatgctattcagagaacattaactcttgtaaataaatcgccaaactcatctcaattgggcagacagattttctgggacttttttttttttttttttttttgaagtcttgctctgtggcccagcctggagtacagtggtgtgattatagctcactgcagccgccaagctcctgggctcaagcaatcctcccgcttcagcctcccaaagtgctgggattacaggcatgagtcatggcaccctgccaagaagtcactttaatcaaagcaactggcactgttatatcaggccatggtaacagctgtcccatgcaactatgcattgtcctgtggtgtcattttttacagtgatttttttttacattacatttctaatgtacaacctctccatgatttgtcttttaaatgtttgttaagtactatcttatgtgccaggcactgttataggtgctgtggatattgtgctaaataaaataaacaaaatttcctgccctcatggggcttatacttctgggtaagatctaccctttattgagcacttaccattggccaagcactttctttgcactatcttattattctcgcagcatttttggggaagtttttcaaatctacagaaagttaaaagatacaccattaacactcatataccctttgcttagacttgtcagctactaaaactatattttatctttctctctgtgtatatatacacatatatgtacatatatgtgtatatatacatatacatatatacacatatgtacatatatgtgtatatatacatatacatatatacacacgtgtatatatacatatacatatatacacacgtgtgtatatacatatacatatatacacacgtgtgtatatacatatacatatgtacacacgtgtgtatatatacatatgtacacacgtgtgtatatatacatatgtacacacgtgtgtatatatacatatgtacacacgtgtgtatatatacatatgtacacacgtgtgtatatatacatatgtacacacgtgtgtatatatacatatgtacacacgtgtgtatatatacatatacacacgtgtgtatatatacatatacacacgtgtgtatatatacatatacacacgtgtgtatatatacatatacacacgtgtgtatatatacatatatacacgtgtgcctatatacatatatacatgtgtgcctatatacatatatacatatatgtgtatatatacatatatacatatgtgtatatatacatacacatatatacatatacgtacatatgtgtatatatacatatacatacatatatatgtgtatatatacatatatacacatacatatatgtatatatacatatatgtatatatacagctctttccatatatgtatctctctctatacttcatttatacgtagagagggtttgtgttagttttgctaaacatttttttttttttagacagggtctcgctctgttgcccaggctggagtgcagtggcacgatcatagctcactgtagccttgggctcctgggctcaagggatcctcccatctcagcctctcaaagtgttgggattacagatgtgagccactgcacccatcctgctaagccattttttgctaaaccatttgaaagtaaattgtagatattatgacacttcacctgcatattttagaatgtatctcctaagatcaaggacatgctcctaaaaactatgataccatcacacccaagaaatttaatattgatacaatttatctttttttaaatttatttatttaagacagggtttcactctttttgcccaggctggagtgcaatggcacaatctcagctcaccacaacctctgcctcctgggttcaagctattgttctacctcagcctcccaagtagctgggattacaggcatgcgccaccacacctggctaattttgtattttcagtagagatggggtttctccatgttggtcaggctggtctcaaactcctgacctcaggtgatccgcctgctttggcctcccaaagtgctgggattacaggcatgaaccaccatgcccaggctttttttcttttttgacatggagtcttgctttgtagcccaggctggaacacagtggtgtgatctcggcttaccacaacctctgcctcccaggttcaagcgattctcttgcctcagcctcacgagtagctgagattacaggcacccaccaccacacccagctgacttttgtatttttagtagagatggggtttcaccatgttggccaggctggtctcgaactcctgacctcaagtgatctgcccaccttggcctctcaaactgctgggattacaggcatgagccaccatgcctggccattatttatcttataatccatattcaaatatctgcaattaccccccaaatgtcccttacagtctcttccccccagtccagagttcagtaaaggatcatgcatacatttgaaagctatgtcttgtcactgtcttttaatctagaagagtccctcatctcttttgtcctttcgggatattgacagttttggggtccgggccagttgtactgaataccctgacatctggatctgctttattgttttctcatgatttggttaggattaagcttttatggctagaatattaaacaggtgatggtgtgtctttcccattgcttcatatcagaaagaaataatgtaaatgtgtcccattattgatgatgctaagtttgatctgttggatcaaacttaatatgtcttcattggaaacatacattttggggttaataagtaatctgtggccttcaagactacgagactgtcttgttctccacccacctttcacccagtaatgtttgtgtttgtttgttttgagatgaagtctcgctctgttgcccaggctggagtgcagtggcgcaatctcggctcactgcaaccttctgttcttcttctcttgcctcagcctccctcccgagtagctgggactacaggcacgagccacttcacattgcaagttttgcttttttttttttttttttttttagtagagatggggtttcaccattttggccaggctggtctggaactcccaacctcaggtgatccacccgccttggcttccgaaagtactgggattacaggcgtgagccaccgcgcccagcccccacccagtagttttttttgttttgttttgggttttttttgtatttttagtagagacggggtttcaccatgttagccaggatggtctcgatctcctgacctcgtgatccacccaccttggcctcccaaagtgctaggattacaggtgtgagccaccacacctggccaacccagtagtttttatcatcccttgatgatccctccctggattatcatgctggtggttgcaaaattgtaactttctaattctaccattgcttcctcttttattaggtaatattcccccccaaaaggagctcccgccctttttctggggtatcactatggactcataaacttttttttattttatgtgttataatccattactatggttattctattttcccttggttttattagggtatcatttacataaaatgaaatgcatagatattaggtaatatgtaatctgatgaattttgacatatgtatatacttgtgtaaccaacacctgaatttaaccaatactcccaatggatatagaaatttccattactccagaaagttctcatgcacttgttacttactaactccaaaggagaaaaatgtacctctccactgttctaattttatcatcatagattaattttgactgttccataacttcctataaatggaaccatctaatatatagtcttttgtgtttagcttttttcactaaggatgatgttttctagattcatccatgttgatctgcatgtcagtggttcattcctttttactgctgggaagtgtaccgtctcaggaaatgatagtccagggccgggtgcagtgcctcacacctagaattccagcactttggaaagctgaggtacaagaatcgcttgaaaccaggagtctctacaaaaaattttaaaatgagctgggcttggtggcacacacttgtagttctagctacttgggaggctgaggtgagaggactgcttgagcccaggagttggggtctgtagtgagctatgatcccaccactgcactccaacctgggtgacagtgtgagaccctgtctctgaaaaaataaaaaagaagatgataccctaagataaaggcttcagaagcagctctctctgaccgtctcctgcccttctgtctctggcctcttattctcccctgaggctagtcatagaaactagaatccctcttccccaaggcagggtttagaaaccagaaactggcagggcgcagtggctcactcctgtaatcccagcactttgggaggtcgatgcaggcggatcacctgaggttaggagttcgagaccagcctggccaacatggtgaaaccccatctctactaaaaatacaaaattagccaggtgtggtggtacatgcctgtaatcccagatactctggagactgaggcaggagaatcgcttgaatgtgggaggcggaggttgcagtgagccaagattgtgacactgcactccagcctgggcactagagcaaaactccatctcaaaaaaaaaaaaaaaaaaaaaaagaaaccagaaaccttcctccttccccttgccagcggtgaaaccaaacctaaaaatattactctaactccctccccctaaaccaccacacctttctgtgcataaactggccatcaagaaattatccaacctacctggtttgactgtaggtcataagacccccattccagagagggtcctgctgcacacccggaaggaaggacaagaacaaaactctgtctcaaaaaaaaagaaaaaaaattctgtgtgtgtgtatttctcattctttttgatgctcaaattgtcccaaatttgaccattggtagtcctctcaaattaattcctgtgtcatctttgggacaatcttaattttaaatgggccctgtgggacttaaacttgtccaacactatgatcggttctgagttcagaaaatagtctctctaaatttttgttccaatctccacagatgtagattcttacctcattcccaaagctagtcactccttaatctacaacagccattcttcagcaacactgaagactcttatgacataaagttgaaacttctttccccaaatgatgcatgcatccgacacacaggcagacacacacgtgcatgcgcagacacacaggcagacacacacgtgtgcgtgcggacacacaggcagacacacgtgcatgcacacacacacacattttgccagtggttcttggattgtttacagtgatctctaaatcactgaacgcctactatgtattagagattgtgctagatgcaaagaaatgcaaagggaagaaaataagaaaattaacatttaaaaaagacctaggccccatgtggtggctcacacgtgaaatcccagcattttgggaggccaaggcaggagggtcacatgagcccaggagttggacacaagcctgggcaacatagtgagacctcatctttacaaatatatatatattttttaattagcctggcatggtggtgcatgcctgtggtcccagctagttgggaggctgaggtgggagaactgcttgagccctgggggccaaggctgcagtgagcagagattgcacagtccagcctgggcaacagaacgagaccccgtctcaaaaagaaaaagaaaatacctaccatgtatgttccggacattgtactaagtgtttgatacatgtcatcttaacaaagatgcataaaatagagatttcataaactaacaaattatcacagcacactagaatacatactattgtaaataaaggcatgtagtcactgaattacattcattcaccagatatttcttgaaaacttcctatgtacaagctctgccccaggcgtgggggatacatctgtgaataagacaaatgcagcctgtgccttctagggctcaagtctagtggaggaaggcagacacataagcaattaccatcagagctccaacccacacaaacatttttaaaaacatattattgtagagacaggttctcactatgttgcccaggcttgtctcaaactcctggcctccagcaatcccctcacctctgcctttcaaaacattgggattgcaggcgtgagccactgcatctaacccaaaaatatgtttcaaaaagaaaaacaaaatctaaaacccactgcctctgaatctgtactatattctttggaagctcctcacaggtgacaaattagcattgtcttatatacaacccaaagccctctgagcagagcttgatgaataagtggataattaatatcttttttttttttgagacagaatctcactctgtcgccaggctggagtgcagtggcatgatctcagctcgctgcaacctccaactccctggttcaagcgattctcctgcctcagcttcccgagtagctgggattacaggcgtgtgccaccatgccatgcccagctaatttttgtatttttggtagagacagggtttcaccatgttggtcaggatcacaagctcctgaccttgtgatccgcaggtgcagatagaaaagaaatcccagattgagtgttgtgctgtaatcctagaaaacaatcgatcaaatcagaacagactccatgaataaaaagaagagattccaaccagaaattaatgtcagaaatttgaaaagggaatatcatttcagattcttcagcaccaaaagatcataagaagacatgatgaataactttatgcctatgtatttgaaaatttaagtggaacagaaatatttctagaaaaaagtcttacctaaatggacacaaaacataatagaaaattggaatcatcctataactattaaagacatttcatctctaatttaaaaggttcccacaaagaaaactccaatccctaatgcctttgaaatctaccacacttttaaggaagaaataatgccaacatcacataatttcttccaaaggccaggaaaaaaggtcaccaaccgacatgaaagcaacataacattgacaccaacataggagataaggtgcaaaaatatctctaatttcatttcattcagttcaaaccgtgatacagtttgcctgtgtccccacccgaatctcattttgaattgtagttcccataatccccacatgttgtgggagggaccgggtgggaggtaattgaatcatgcgggcagttacccccatgctattctgatcatgagttagttctcacaaaatctgatgattttagaaggggcttttccccccattcgcgcttcacttcttgctgctgccaggtgaagaagaccttgtttgcttccccttccaccatgatcataagtttcctgaggcttccccagctatgcggaactgtgagtcaattaaacctctttcctttatcaattacccagttttgagtatgtctttattggcagcgtgagattggattaatacaaactgctttcattaataaaattgcatcaatttgttgcagcaatgttgggaacatctagtacccttgttctcagtcttgagcttgcattagaatcacctggaggggttggctttgttaaaccagattgggggcccatctgtggtcagggatggggcccaagagttttaaatacaacaagatccttggtaatgctgttgcctctgcaccagggaccacttttgacaatcactgacccagtggcacatactattttgaaatcttgcttgccatagaagtaatgttatttggaatgcttggacaggctcagtatgttggaacaacttctaatttaattctctaaggatgtaaaaaaaaaaatcttggttagattggccaacattgatatgattggccaatttcaatatgctaaagtaaatgatgtggtcagctgtaatccctgaaaatttgttttcaagaagttgattatcactgtttttcccccaacatatatatgaattttagcaggatccctttgttttcctaagatttacagcatataaaagagtattccaaatagcattgctttcagattcttctaacaattttataataactgtattatattttcattcatatttgctactctcatacaatgtctttatatttgtctggactaatctgtattggccaaagttacaattgtcaattctctgaatgcttttaatccagttttgtgagagaagattaaccaaacaagaagaccctccttaaaatgttcttaccactcatgtaagatataagctaagtgttgtgcaactttcaatttgactttctctggttggattacaaaatctatacgagattgtaacagcataataagcattgtttccaacattccgcaacagtatagattcaaggagaaactctattattgctaaggtatgtttttatggcttgctacaccataaaaactatacacaccaaaatacatgccagagaataaatgtttttttcaggaaccatgtgagcaatttttttcttttggcacataatatgcaacccaatacaatgataataaggctttctcactgacagtcacaacatgaatcataaaatttgcctatcacattatatatgtttttctttctttggaaatattcgagagactgactaattcaacatgtcatgtttccaagcatcttttaagttttgatggttttaagttctcatttgcaagaacatcattataatgcattggtgtacatgtcattttgttggttttacacatttcataaaataatacacacatatatgtatatatatatatagagagagacagagtttcataattatcacccagactagagactgtgatctcagctcactgcaacctccgcttcccgggttcaagtgattcttctgcctcagcctccagagtagctgggattacaggcgcctgccaccacacctggctaatttttgtatttttagtagagatggggttttgccatgttgggcaggctggtctcaaactcctgatctcaggtgatctgcctgccttggcctcccaaagtgctgggattacaggtgtgagctggctgggcatggtggctcatgcctgtaatcccagcactttgggaggctgagatgggaggattgctcaaggctaagggtttgagaccagcctagtcaacatagtgagacccccatctctattaaaataaataaataaatacataaataaagcaaatcttgcatttaccctttttaacaagatgcaaatgatgtcagtctgttgattagagttgatattttctccaatatttccatttactcttcccatgtttttcaccttattattcttgttctttgtagcattaaaacagtcaacttaagagcaatttgaactagttcaattaaaatgctacaattattgcacatccaaaattttttatctgattataaactttctgaaaaactgcactgcaaattcctaaccaaaactcagttgaaagtcatggcaatattgcaaaaaaaaaaaaaaaaaaaaaaaaattccactcttcaattcacaactaactacaaactattttgatataaaattaaataatacacagctgggtgtggtggctcacgcctgtaatcccagcactttgggaggccaaggcgggtggatcacgagatcatgagttcaagaccagcctggtcaagatggtgaaaccccatctctactaaaaatacaaaaattagccaggcgtggtggcaggtgcctgtaatcccaactactaggaaggctgaggcagagaattgcttgaacccgggaggcggaggttgcagtgagccgagatcgcaacaccacactccagcctgggcaacaagagcaaaactccatctcaaaaaaaaaaaataaataaataaataaatactatactattctgccattataacttgatggtcatattgacactcatgtaccagaaaatcaaatgagatgacaattcaccaaataaactgcttttagccaacgtgcacatttttcacatcccctcctctgtctctcccacaatgtaatgcaattagccttgtgcgattagtaatgtgctcctgtcctcagttcttgtcaagaatccacacaaggcactctaatattttcgaatccattctatttcattatttaaaaagttagtgggacacattaaatttatttcttgacccactaaagggtcatgagcaaagtctcaaaaacactactgtaagacactaaactattaactattgcaagggagtttgtaaaaaatacaataaacagaatagcttacctctctgcatgcagaatgttttctttgctaactttatttttcaaggctggatttataccacactgggcttgcaaacttgctgcttcatgggttggtggggaggggtaggagaggggtgtgtggggtatatatgttttcttttttattttatggtctttttaaaaaattgagatataattcatacaccataaaattcacactattaaagtacaattcagtggtttttagtatattcccaatattgtgtaactatcatcactatctaattccagaacatattaatcacccatcaaaaaaatccatacccatgaagagtaactccccattttccctgcccctggtccctgccaaccactaatttacttcctgtctccatagattaatctattctagatattttatataaaaggaatcacacagtatgtggccttttatgtctggcttcttccacttagcatatatttttaaaggtttatccacgttgcagcatttatcagtaggtcattccatttagtggtcaagtaatatgccattgtatgaatattccacattttaatcatttgtaagttgatgaatgctaggattgtttccacttttagctattatgaataatgctgttacaaactgacgtacaaacttttgtgtagacgtaattcattttagttttctcttgggtgagtggaattgctgggtcacatggtaacttaatctttaattttaattaatttatttataggctgaagtgcagtggcgtgaccttggctcactgcaacctccaccccccagattcaagcaattcttctgcctcagcctcccgagtagctgcaattacaggcgtgcgccaccatgcctggctaattttttgtatttttagtagagacggggtttcgccatgttggccaggctgggcaatgtttaatttttgataagccaataaagtgttttccaaaccagctaccccgttttatatccccgctagcaatggatgaaaattccagggctgggcgcggtggctcacgcctgtaatccagcactttgggaggctgaggcgggcagatcatttgagcgcagtagttcgagaccagcctgggcaacgtggcaaaaccctgtctctacaaaaaataaaaaattagccaggcgtggtggcatgcgcctgtggtcccagctacttgggaggctgaggtaggagtatcacttgagccccagaagtcgaggcttcagtgagctttgattgcggcactgcactccagcccgggcaacagagtgagaacctgtctcaaaaaataataaataaataaataaataaaaattttaaaaacaaaattccaaattctccacatcctcactaacatctcccacctcagcctccctaaaagctgtgactacaagtgcgagccaccatgctcagctaatttttttatttttggtagagacagggtttcgccatgttacccaggtcttaaactcctggactcaaactatccacccactttggcctcccaaagtgctgggattacaggcttaagccactgttcctggccttttttttttaaataaatgatttttaaaaatttttatattgacaaggctgggcgtggtggctcacgcctgtaatcccagcactttgggaggctgaggcaggcagatcacgaggtcaagagatcgagaccatcctggccaacatggtgaaaccccggctctactaaaaatacaaaacttagctgggcgtggtggcacatgcttgcaatcccagctactcgggaggctgaggcaggagaagcacttgaaccagggagtcggaggttgcaatgagccgggatcgcgccactgtactccagcctggcgacagagacttcgtctcaaaaaacaaacaaacaaacaaaaaaattacattgacaaataaaattagtatatatttatcaagtacatgttgttttgaaatatatatacattgtggaatggctaaattgaggtaattagcatatgtgattaactttagactttaaggatatgtactcgtcataatggtctctattagccaggaacctgacaggaaacagatggctcattcaaattagaaaaattagtggaaggtttaataaagagactacttacaaaggtgtggacagagtgttagagaaccgcaagggaaaatacagtaatcctatacagccaatcctatccctagcctgaagggaataagagaatggttactgtattagtcagaattacaaaacagaactaatggaatatgtttgtgtaaggagggcgaggtggcttacacctgtaatcccagcactttgggaggcggaggtgggtggatcacctgatgtcagaagttggaggccagcctgactaacatggtgaaacctcgtctctactaaatacaaaaaattagtcaggcatggtggcaggtgtctgttatcccagctacttgggaggctgaggcaggagaatcacttgaacccgggaggcagaggttgcagtgagccgagatggtgccactgcattccagcttgggcaacaagagtgaaactccatctcaaaaaaaaaaaaaaaaaaaagaatatgtgtgtgtatagaaagaggtttatcataaggaattggctcacacagttgcagagattggcaagtccaaatgtgcagtgtgggctggcaggtttgaaacccaggaaagccagtggtatagatgaagtcccagagcgggctgctggagaattccctctcatgtaagggagaggccgtctcttcattctcttcaggctccagctgattgaatgaggcccatccacattatgaagggtaatcttcaccaattaaaatgttcatctcatccaaaaacacccttgcagaaatactcagaataatgtttgaccaaatatcggagtacccagtggtccagccaggttgacacataaaattaaccaccacctgaaaataaaaagttgtgtagagatgggcaccttgggataaaatgatactttttttttattattgtactttaagttctagggtacacgtgcacaacgggcaggtttgttacatatgtatacgtgtgccatgttggtttgctgcacccattaactcatcatttacattaggtatttatcttaatgctatccctcccctatccccccaccccaccacaggccccggtgtgtgatgttccccgccctgtgtccaagtgttctcattgttcaattcccacctatgagtgagaacatgcagtgtttggttttctgtccttgcgataatttgctcagaatgatggtttccagcttcatccatgtccctacaaaggacatgaactcatcaaaaggatattctttttatatacatatatatagagataggatctcactatgttgcccaggctggtcttgaactcctgggctcaagcaatcctcccatctctgcctcccagagtgctgggattacaggtgtgagtcaccatgcccagtcagaaatgataccttttgattgagagatgtagccagcctgaagcaaatcctgcaagaagggagccagagggataaacgcccttgaactcactccactccctttcaccagtctcctgtctgggctccccactggatgaacccaactggaagccaggaagaatgagcccattaattgtagctcataccagaccacgagaacagaggataatgaatttcttggggcaaagaatagggtgaaaaagggtgaaaagcacatccacagggggaaatggaagatatcctacacacaagattatgccacagtaataagcaattccagcggactcaaagaaagtagaaggaaggaaataagatcaaagcagaaattagcacaacagacaaacatacacttgacagcaacaagtcagtcccaagtttgttcttcaaaaaagagaaatacaataagaaatatctggcaagactaatcaagaaaaagagaaggcatagataattaataataaaaaacaggccaggcatgatggctcacacctgtaatcccagcacttttggaggctaagtcaggaggatcatttggatgccaggagtttgagaccactctgggcaacatggcaaaaccctgcctccacacaaaaaatttttttaattagccaggtgtgatggtgcatacctggagttccagctacttggaaggctaaggcaggaggattgcttgagtgtgggaggtcaaggctgcggtgagtcgtgatcacaccactgcactccagcctgggcaacagagcgagatcttttctcaaaaaaaaaagaacaaaacagataggacaacttcatgccaatgaattcatagaaaagtacaactttctaagttagggaagagcagggtttaggaaaggactttctttcgtctctctgatctggcctggaatccggggtgttgactaatgatcaagggtatccctgggtgtggggatgagctggccttggccacaaagaagcctgaataatgaagtggactgtggttctaagagtagtcatagctaatagtagctgttagctagtagatgatgtaatttccttccattatgcctcagttttcagtcaagacttcttcaaagttatagcagttctcgtctaggttatggggaattatgtgtaggcctgagtctctatttgaggcaaagtaatagaagagagggcaggaggtatatccctgcctatcaaggtagccagaggtttgccatggtactgaagaaaatgatcagcagctgaattagccaaggttcatgggcaaagatgaggctggcagataaagccagacaaattcctggttaaaagtcacctcctgagctatttagagaaacagttgattcagggctgggataggaacgggatcagctgagcttggaacatcttgtaataccagaaagcaggacactatcaaagactattggggttgtgttaacaggactcagggctaacttgaagagaggcttccactggccagaaatgggacaatttgagctttgataagaaaaataatttcaatgaactgaaaaccatcaaatgagtttaaatccaagagttcacaatacttgaaaaacaaaacttcattgtcacaattggaagatgctaggaaaatgatgcattattctggaaaataaaaaataaaagttaagaatcaaatatttatcctggctttcctgaatgaactgtgccccaaggaacccaaatagttgacgagaggaagtctttctttagagaagtagtctagccttggctgggcatggtggctcacacctgtaatcccagcactttgggaggccaaggtaggtgtatcacctgaggtcaggaggtcgagaccagcctgactaacatggtgaaaccttgtctttactaaaaatacaaaattagctgggtgtggtggcgcatgcctgtaatcccagctacttaggaggctgaggcaggagaattgcttgaacccgggaggcagaggttgcggtgagccgagatcaagccattgcactccagcctgggcaacaagagcaaaacttcatctcaaaaaaaaaaaaaaaaaaaaaaaaaaagagaagtagtctagactaattaaaatctcactattttgaaacccctgttgaaataatggatccaagcaatgaccaacaaatggctgttagtaacaggcaaggagacatcatgtgtctcttgaccaaaagaaacaacagtgcttattcttgaaaaataaaaacaccagcctagacaacatagcgagaccccatctaaacaaaaaatttaaaaattagccaggtgtggtggtgtgggcctgtagtcccagctattcgggaggctgaggcgggagaatcacttgtgcccgtgaggctgcagtgaactgtgatcaccccactgggtgacagggtgagacgctgtctcaaaatacataaatacacaaataaaaataaaaacaaaagtaaaaatccaaatctgatgatgtctctagatcttaatatcaactttaaaaaacagttatataataaatacctcagagatgcaattaacaaaatccataatatggaaacctacaggacatacaactgttgtcttcaacaaacaaactgcaatgaaaatagaggaggagtgggaaaggagggagggagggagagggaaagaattcctgtaaattaaaagacatttcagagatatatcatctaatttcaaatatataaatcaaccctatgtgggtcctgatgcaaacaaactataatacaaagttatgaaacaaaacattttgaacattggagaggatatcaaggaataatgatttatttttataggcatgctttggggatgcattctgaaatacttttaggaataaaatgtttggaatcctaaataatctagtgtggatataaatgaaataaggttggccatgaattcatcatctttgaagctagtttgttgaaattgggtgatgagcacacaaaggatggatgtcctgttcgctccatttttgtttatttaaaattttacttagccaggcatggtggcatgcacctgtggtcccagcttcttgggacgctggggtgggatgaccgcttgagcctgggaggtggaggcttcagtgagctcagatcatgccactgcattccagccagggcatgagtgagatcctgtctccaaataaataagaaaataaataaaaataaaataaaataaaataaaataaaaataaaaaaataaaaaataaataaaataaaataaataaaaaataaaataaaaaaataaataataaaaataaaaaaataaacaaaataaaataaaatagtacatcctggccaggcacggtggctcatgcctcctagcactttgggaggccaaggcaggcagactgcttgagctcaggagtttgagaccaccctgagcaacgtggcaaaatcccatctcaacaaaaaatacaaaattaggaaaattagccaggcatggtggcatgctccagttgtcccagctactcgggaggctaaggtgggaagattgcttgagcccagaaggtcagggattgcaaggcttgcagggcttgcagtgagccgtgattgcgccactgcactccaggctgggcaacagggtgagaccctgtctcaaaaaaaaaaaaaacaactttgtggccagggacagtggctcatgcctgtaattccagtactttgggaggctgagatgggaggattgcttgagcccaggaattcgagaccaccctgggcaacaaagcaagatcccatctctaatgtttataaaaatgtaaaaagaaaaaattaaagttacaagaaaataaaattttaaaaagcaataaaattttacataattaaaagctcacgtcctcagggaggctttttccacccaccctatctaaagcagcttatctttccccattattttctagcacagccccgtgttttcttcatggaactgatcacaatgttactttatctatttactaggttatttctttctgctagaaatttagtttcacaagaataaaaactgtttgccttgtttgctgctgaacctctggggctgcggctggcacacaaaggtgcctgcccagccccatggctcacgcctgaaatcccagttaatcaggaggctgaggcaggggattgtttgagcccaggagtttgagatcagcctgggcaacatagggagacaccgtctctgcaaaaaaatttttaaaaatcaggcaaattatagtggtgtgtgcctgtggtcccagctactccagaggctgagatgggaggatcacttgagcctgggaggtcgaggctgcagtgagtcgtgatcatgccactacattccaacctgggtgacagagggagaccctgtctcaaaagaaaaaaggtgcttaataaatcttcgttgcttggaaggacaggtggatagataggtcaactaaagagtaagaagcagccggggcatggtggctcacgcccataatcccagcactttgggaggccgaggcgggtggatcacctgacgtcaggagttcgagaccagcctaggcaacatggtgaaacctcatctctactaaaaatacaaaaaataaaaataaaaataaaaaaattagccagatgcggtgtagccagatgcacgcctatagtcccagttactcaggaggctgaagctggagaattgcttgaacctgggaggcagaggttgtagtgagccgagatcacaccactgcactccagcctgggtgactgagtgagactctgtctcaaaaaaaaaaaaaaaaaaaaaaaagtaagaagcacatgttggagcaagaactaacaaagaaatacatttatgacaacactttccacaaagacaccagaaaaggaagggagattcaactatcgacccctaggatctttggagccagctaaccgcatttagccgtctctccagctgcatgagaaaattaactagagtcacaattgcccgtagccaccaatcctttctttgaatgaaatctcatgagacagcccaatatgtaaaacatgataaccaaaatatgatagccaaaagcaatttattatagtttagcctcaaaaaaataaaaataaaaaaattatccagtggttatgaggagtctaggaaaacctgtcccagtaatgccaacttggaggtgaagggctgactggggcagctgagaagtgggaccttctgtttggcaggcttcctctcccttgcctggtcatggttttctggtgagaagagtgttcctggccttgctggaggttcccatggccccgaactaacagtgtttttctgaaatttcgacctgctccgtttgagagagtagaattccctcatcaagtcctccacctcccactgctcttccttcagcctctggcagcagtgcagggcggcagggtcgatggggtgagcttctgtgttgaagatgtaccccccagcccccaggatgcactccccatagggggtgatcaccgcgtcgaaggtggacccattgttgtggatgaagttggttgggtcaaacaggaggtagaggtatttcacagtctcggccaggaagaacgactccatgcggttgtccagcttgtggtctcgcagatctttgatctgacatgtgggagaaggaagcaagctggaacaccatcacaatttagtagtaagggtcaggcaatcccttaagaaggcctgttctgccacaaagcagctgagggcctgtgagcaaatcactgaacttttcagaacttcactctttcccaagccaccatcatctctcacctggattatcacataagcttccaaatgggctcccagcttccaatcttagccctgcagtttatatacacacactattttaaaaaatagggacagggtctcacaccatgttgcccaggctggtctcaaatccctgggctcaagcaattcctcctaccttggcctcccaaagtgccaggataacaggcgtgagacacacaccaagctcctacagtatctgtataacataagtcttcctgtcaattctctactcacaactttctgtgagccctccatttcatgcaggataaaaatgcaagtcatgacctggcccctgctcccttcctgccctcacctcttaccactctaagagctccagctgctgcctttctgtcctgagctagcacagcaccctcctgcttcgggctctttgcatctgtggttctttcagcctggagcactccgcctccagtttttctcatagcttgttccctcccttccttcaggtctctgctcaaatgcttcctcaccagaaaggtctccgctaaccttgctctatgacatgacaatctcctatcccctttatcccaactttttgtgactataaacatagagctaatcgtcccttttaatgatggcagagtattccatcgtgaaaatggatcaccatttacttggctaatcctccttggaagggcattcagatgattaccaagtttttttttttttagagatggagtttcactctgttgcccaggctggagtgcaatggcatggtctcggctcactgcaacctctgcctcccgggttcaagcaattctcctgcctcagcctccagagtagctgggactacaggcacatgccaccacacccaggtaattttttttgtatttttagtagagacagggtttcaccatgttggtcaggctggtcttgaactcctgacctcgtgatccgcctgccttggcctcccaaagtgccgggattacaagcctgagccactgcgcttggccaattaccaagtttttgtaagcaactaataaggggtctttttttctccactcagacccaaagtatcgacacttactaggttcaactgctgttgatgaaaactattgacattgttttagtaaggagtcttatttagagaatttcaactgagttttcaggcatggatgactaagattacttgctacaaacatttattttagcttctcagaattagtaatacttctaaacaaaacattctcagtggactctatcttacatttaaaaatatgactcaaatatggtcttgatgtatcaagatgattatttccttgccctgtttgagaaaggtcagacccctgttcccatcattcaccatggaagacctccaaagggcttcatgttcatggaaatgagcccagcattcctaggaaggccccagtgggcttatcattttggtttttcacacaatacagcatattagaaaccaaatcatatcaggggtttattttttcccttccacatgtaggtcttctctcttcccctacacatatctatattttacttatagaatataatcacattacaaacttttgcaaaataagtgttttgttgttgttttgaattccataccccaacactgtaggcttttcaggggattttcttccagactattttcttctactttcatatttatatcttgcctgcttggttcctgcatggatgtgagatggctctcacctttgaccctttcaatctattcttcacaaagcagccaaagcgatctttctaaaatacaaatcagatcatgtcactgctctgctgtaaatcctaccaagggttcacattccaagtagaaaaaaaaacccaaactctttcctgtggcttacacaaaaccctacatgatctagcccctgcctacctctgggaccttatctcttcccacttttctccttgcttgctccgctccagccacactggccttctgtctaccagatacacattcatggtttttttctcattaaaatgtaagctccatgagagcaaggccactgctgtaacccttgggcctagcagagtgcctggcatgtgaaagacattcaagaaatatctgtgagactaagcaggactgctttgttaaggagtcccaggtttgaatatagggctatgggactctggattccccttaaaatctattttagtgtctcacaaaacttttcgctaaactcaccttttcaaagtcacctattcaaacagatcaaagatctccactgtgggaggaatgccaagggccggggtcaagatcccaaggaactaattctagctctacctctactagctgtgagatctttagcaaggcacttagcttctctgttctttggtctccccatctgtaaaatatgagcattatgtatatctccaaggtcccttctagtgctgatatgtcagaactcccaaagctctacccttaaagaggctttttagcagcaaggggagactcttcccagttcttggggccatgcaaacacttactgttgcaaatccgcactccaccttgctgattttttcaatggattccacagcatctcttccgagttctaggagggtgggatcccccgtggcacggtagaggtacattgcgctttcaataagttctgcaaagtccaaagcagaccctcctcactcagtggctgcacagagatggcctggggcctcttagggccgtgagggactactcccctccatatcttgtccataaggccccaactagcaggaacacaggatacctcacccagtgctgagtttcagagccagtatacccaaagcttgaagctcagtggagaccagcattaaggctgaccagtgacttccaccacaagggagagaaaggtggccaggttctggcatagagaaggtggcggaggttgttgcctaattcccaatatctgttccccgcttcctccttagtagcaggattcctaactttagctaagcacaggctgcctggctgccaacactaactattctaacagctaggtgggattaaggacaccatggcgagccatataagcccagaacatgagagagaaatacatttctatcctaattaagctactattttttttcctgtcactcagagtctaacctaattctaaaactcaaaagaagagtaagagcttggcatcataaggctcgttctaagataggatggaccaaaagaaaaggctgagatatccaagagcaggccaggcatggtgggtggctcatgcctgtaatcccagcactttgggaggccaaggtgagaggatcgtttgaacccaggagtttgagaccagcctgggcaacatggcgagatcttgtctctacaaaaattaaaaatgattagctgggtgtggcatgcacctgtagtcctagctactcaggaggctgaggtaggaggatcacttgagcccaggagtttgaggctgcagtgagccatgattaagccactgcggcactccagcctggatgacaagagtgagaccttatctcaaaaaataaaaattaaaaaaataaaataaaataaaccaccaaaccgtcaatctaacaaagacgtagtcatcagttcactgtggccagaaaaagtgatgttttgtcttgcccaattctatgccacaactggaacttgatgttaagacatgagctctaccttaagatgaatattagccaacaggagtgggtccagatgagaatatttattctagagataaggaaatccaaaaaaaatgtgtttattgctttcaaatacctgaagaactgttgtagagttgacttcaagggtggcctcagctcagtatgtttttctacttcatccatcttttctaagagacagaagaacccctgtctcctttctataccatcatctccccctgaccttctcctgtcctgtttcctcctgggcttgatcagtgcttctgtcccttttggcttattgctgcaaactctggttcttattttattccgttaattacttttttgtgacagagtctcactctgtcacccaggctggagtgccatggtgcgatctccgctcactgcaactctgcctcctgggttcaagggattctcatgcctcaacctcccaagtagctggaattacaggcatgcgccaccagccctgactaatttttgtatttttagtggagacagggtttcgccatgttggccaggctggtctcaaactcctgacctcaagtcatccgccagtcttggcttcctgaagtgttgagataacaggcgtgagtcactgcacccagcctctagttcttattttagagaaaaggtctctgcctatctccccagttctctcttacttcctcctcccctctcctcacaggcctctagacaattgctaatctaattgctcatattctaaggcacagactagggtacattcattactagatgaacacattctgtgtgttcaaaggcagaaaagacagtgccctcatgggaggcctcctcttctgcttcttttttcggcttcttcttttttttttttttttttttttgagagggagttttgctgtgttacccaggctagagtgcaatggcatgatcttggctcactgcaacctctgcctcccaggttcaagcaattctcctgtctcagcctcctgagtagctgggactacaggcacatgccaccgtgcccggctaatttttgtatttttagtagagacagggtttcgccatattggtcaggctggtctcgaactcctgacctcagttgatccaccgccttggcctcccaaagtgctgggattacaggcgtgagccaccacacccagccctcttctgcttctagcagctggtgggccagtgccctcatgaccagccatcacgcttctctcctcacatgtgggcctcctaagcatgttagttattgctttactttcctgtgcatctgaccaactctgtcgagcagtggtccccaaccgttttggcaccagggaccagtttcatggaagacaatttttccatgaactgggcttgtaggagatggttttgggataattcatgtgcattacatttattgtgcactttatttatattattattacattgtaatatataatgaaataattatacaatccaccataatgtagagtcagtgggagccctgagtttgttttcctgcaactagacagccctatctggggttgatggatgacagtgacagatcatcaggcatcagcttctcctaaggagcacacaacctagatccctcacatatgcagttcacaatagggtttgtgctcctatgaacgtctaatgccaccacggataagacaagaggcggagctcaggcagcaatgtgagcgatgaggagcagctataaatatagatgaagctttgcttgctcacacgcagctcacctcctgctgtgtggcctggtttctaacaggccatggacttgtaccggtccacggcctgggggttggggaatccctgctctagaggaaggagacagcccaaagttcagatttggacttagaggaaggtaaaagcctgcagaggcctttaggctaggctctgtgctccaacactgctgatcagagagacatatacgaaagtacagggctctggccaatttagtgaaagagtagtccttatctcctatttgccattgttttggggtaggagggatgactggattaacgcactcctggattcctgacagcggtgccttatgttttttttttttggagacagggtctcactccattgcccaggctggattgcagtggcgccatcatggctcactgcagctacgaccacctgggctcaagtgatcctcccaggtagctgggatgggactacaggcatgcaacaccactcttggctaatttatttatatttcttatagagacaaggtcttgctatgttgcccaggctgatcttgaacccctgggcttaaatgatcctcctgcctcaggcttccagagtgctgggattacaggcataagccactgcatctggccagtagtgtcttactttccatgaatgccttcctgccagcctgtcccaaatggaacaggttgcctctgttaagtagcaagctccttgtcactcgtggtaactaagcaaaaactagataaccacttgacagggccatattaggaaaattccaattagaacacctctcaggttccctctaaccctaagattgtgcaagcctatgtcttacatttagttccaaaccctaatctttacctgttggtaacaccagatacgataccttctcagagcttcttatttttaaaatttacttatttatttttttgagatggagttttgctcttttttgcccaggctggagtgcaatggcgtgatctcagctcactgcaacttctacctcccgggttcaagcgattctactgtctcagcctccccagtagctgagattacaggtgcacgccaccatgcccagctaattttgtatttttagtagagatggggtttcaccatgttggccaggctggtctcaaactcctgacttcaggtgatccacctgccttggcctcccaaagtgctgggattacaggcgtgagccaccatgcccaaccaagtttcctgttttaaaaacatgccatgagaacaaatgcatgagaaacatcaataacagtggcctctaaggagtcaaaagttgatgaatttgctctttattccctctcctggtcccctctacacctcctacgataatcacttgagttagaagaggaaggaaatggggtagaggaaggcaggataaccagaaggcctgtcccatggctaaaaggcaattcaggtgggaaagtgggaagtgtctaagacaatgggctcatagcctgttttggggtgggggatgactatgtgtgctgactaagcttccttcctttgtccctctttttctttccctcctcacaattttcagcttccctgaagtgaatcaaatgacattagggctagaaaggaacctatgagagtgtctcaaatatagtcctttgcttgattctgagctgcaaatggggaggtggaagagactaggtaattcctaaggtccgccccaaagttctaacattccatacacgtaagcataatttatctgacccatggacttaggaagcttgcctacacttctgaaatcctgatggcaggagctcaaaaggagtcaaccttggccttttccttctcactcatttcctgatttgaaagagcatatggggccagtcgcagtggctcacatctgtaatcccagcactttgggaggccaaggtgggcggatcacctgaggctgggagttcaagaccagcctgaccaacatggagaaactccatctctactaaaaatacaaaattagctgggcatggtggctcatgcctgtaatcccagctactcgggaggctgaggcaggagaatcgcttgaacccaggaggcggaggttgcggtgagccgagatcacaccattgcacttcagtctgggcaacaatagcgaaactccatctcaaaaaaataaaaataaaaaagagcatgcaatttagttaggagccctgggttccaggcctagctcctgcacttaagagccagaggcgagccatttcatcccactaggcctcagtttccatatctgaaaacatggggataattaactcctagtaagaaaaccacccagagccactgaaaggaacagatggaaagaaatgaacttgtgggcagttgtggaggatggagccttgtagaggggatttggggtttcagcaaccagagcctgtgggcagatgacaagccagaaatgctgctcacctggccgaagtgggtagccctctcgcttctccactgtgtatccctgaggaatgttgtagaattccgggagccccccaaactgcttccatacagtgtagtagttgaggaaggtcctcatggcattgtcaatgtctccaatgaggctctgtgggagaaagtggctgtcaggcaggtagacaccaggcataaaaccccacagacaaccttaagaaaagacaaagtaaaatctgtggggccaaaaaggccttgaatcaatccctgagtctgccagttactcagtgtggtgctgagccaggcactggacttctctgagccccatctataaaacgtaaaatacaccacctatctcatgcattgttggaaggaacaaagattgtatattaagtccctaaatcttcagagtcaatgtcagctaacagttttggaattcggccagccagttaaaaattctaagaatagagaaaagtttgtgctaaggctcactcccacaccacacccccaaaagataaccatttttgtttttgtttttgagacagggtctcgctctgtcacctaggctggagtgcagtggcacaatcacggttcattacagccttgacctcctgggctcaagagatcctctcacctcagcctcccagtgctaatttttttattttctgtagagatgggggtctcactttgttgcccaggctggtcttaatctcctgggctcaagtgatcctcctacctcagccttccaaagtgctgggattacaaccatcacccatcttgcctggcctcagataaacattactggtttcttgtataacctttcagagtttctttatgcatgagtatatgttattttccccacactaaaaaatagcctttggttctttattaatagggatattaattatctccatatttttagatatggaaatttggctttcagatatttttatttgaattggttccaacaactaatgtggcaataaataattctgtatatatgtcacatcaaatagatgtaaaatgttatgtgtaagatacattttcagaattaggatcactgggtcaaaggatatatgcatttataattttaccactattgctaagtagccattactattaatgtaatctcacagggaagcagctgaccctgacatcttcattggatgtctcatggacagaacaaacttggcacttcctaaacaaaattcttggttcccttactttcccacgaaattgcctccctactttggcctttttcccttcttggtaaatgacacaatgtctacctggttattctggatagaaacccggtggccactttttttttttttttttgagacagggtctcactctgtcacccaggctgcaatggcatgatcatggctcactgcagccttgatcttctgggttcaagcaatccttccactgcagtctcctgagtagctgggactacaggcatgtgccaccaccctaggctaattttttatttttatttttatttatttatttttatttttttgagacggagtcttgctctgtcatccaggctggagtgcagtggcgcaatctcagctcactgcaagctccgcctcccaggttcatgccattctcctgcctcagcctcccgagtagctgggactacaggcgcccaccaccacgcccagctaattttttgtatttttagtagagatggggtttcaccgtgttagccaggatggtctcaatctcctaaccttgtgatccgcctgcctcggcctgccaaagcgctgggattataggcctgagccaccgcgcccgacctaattttttattttttgtagagatgaggtctcactatgttgcccaggtgggactactttttcttaaaacttttaaaaacgtagattataaaaacattttggtacatgcactattttggaacaccaaagtggggtagattagataagctctaagatccttccagctgcaactctaccagaccatgtaatggaaaaacaacgagatggcacagcggcacaagctgcttcctgcccttcctgaggcccactgtcaagaatgagattggacagaaacgcccagtggagaaacacctgttgccaatggccattcctgcccagactggaaatgcactgtcgactttaagtactgtaacactccatggcaaactggaagctcagttcctgacactcaatttggcagaactctaaatctatctaattcactctaggtctctcttccatcctcaacctgtccctccaaaaaaagtactcaagcaattaacaaagtacattatttgacttatacatcagaatgagcttgctttgccagactcatagaaagatgatcacattctttgatcattcctacctgaagaccaggccagtaggcctccaaggactggaagactggcatggacacagtccccttgtacatctgaacccacaggtaccagtcatcgaagcgggtgtagttccggatggctttgttatactctgcagtgggggagatgggataatggacatatgagtgattagggagaaaaaaggcaggcctggacagcggaagcgagaacttacactttggaaagagcaccaggatgcaatgaggcaaggaggctagacaagagcatggattctggagtcaaacttccagctcaaattccagctccagctctaccacttgctaaccgtgacctggggtgggtttttcccttttaagcctcagccttatgatctataaaatggggaggccaggcgtggtggctcacatctataatcccagcactttgggaggccgaggtgggcggatcacctgagattgggagttcgagaccagcctgaccaacacggagaaaccctgtctctactaaaaatacaaaattagccaggtgtggtggtgcatgcctgtaatctcagctacttgggaggctgaggaaggagaattgcttgaacccaggaggcggaggttgctgtgagctgagatcgcaccattgcactccagcctgggcaacaagagtgaaactccatctcaaaaagaaaaaagcagaaaataattgatgtggtttggctgtgtccccacctaaatctcaccttgaattgtagctcccatatttctcacgtgttgtggaagggacctggtgggagataattgaatcatgggggccgtttcccccatactgttctcatggtagtgaataagtctcacaagatctgatggttttataagaggtttcccctttcacttggctctcattctctcttgcctgcaccatgtaagatgtgcctttcgccttccgccacgattgtgaggcctccccagccatgtggaactgtgagtccattaaacctctttttctttataaattacccagtcttgagtacgtctttatcagcagtgaaaatggtctaatacagtaatgttaggtatctgtggaatttttcagtcatttatttataccacaaacattcgctaagcacctactaggttccaggctcctatgagtttgtaaacaagacaaaatccagccttcagagaacttacattctagtaggaacttgaatttatccctcatatctctcccctagattgtaaatccatgaggcctgggactttgttttgtctactgcagaatcccccacactagtacaatgagcaataaacattttctgaatgaacaaagtaccaaatatacatgcaaataaataagataatctcaaacaggagttgtaaggattatatgaaacagtccatgttcagagcttggcacaatgcttggtacatccgtggtattcaataaatatttgttgaataaatgagtaaagtagtccccccttatgtgaggagaatacgttccaagaccctcagtggatgtctgaaaccatggatagtactaaataaactctatatacagtcatgtgccatataacaacatgttggtcaacactgaactgtagagatggtggtcctataaaattataatagaggtgaaaaatcaccacagcctaaagatatcacagctgttgtaattttataatgcaatgcattacttacttgtttgtggtgatactggtgtaaacacacctactgtgctgccagtcataaaagtataacacatacaattatgtatagtacgtgatatttaataaacaaccatttacgcgtttatgtatttactatattattatcattagataactccttcctcttatataaaaaaagtcggctgggcgtggtggctcacacctgtaatcccagcactttgggagggcgaggtgggcggatcacgaggtcagtgttagaccatcctgcctaacacggtgaaaccccatctctactaaaaatacaaaaaaattagctgggtgtggtggcgggcgcctgtaatcccagctactcgggaggctgaggcaggagaatggcgtgaatccgggaggtggagtttgtagtgagcggagatcacaccactgcactccagcctgggcaacagagcaagactctgtctccaaaaaaaataaaaacaaaaacaaaaattagctgggcgtagtggtgggtgcctataatcccagctgctcaggaggctaagacaggaaaatcacaggagaattgaacctgggaggcggaggttgcagtgagccgagatggtgccactgcactccagcctgggcaacataagcaaaactctgtctaaaaaaaaaaaaaaaatgaaacagcttcaggcaggtccttcaaggaattccagaaggcattgttatcaatcatctgagataacaacagttctgtgagtgttactgcccccaaagaccttctagcaggataacatggggaagtggaagacagtgatattgatgatactgaccctaggcctaggctaatgtgtgtttgtagcttagtttttaacaaaaaagtctaaaaggtgaaaacaaaataaaaaactaaaaacagaaaaaaacttagagaataaggatataaataaaatatttctgtatagctgtacaatgtgttttaagctaagcattattacaaatgagtcaaaaagttttttaaaattttaaagttcataaagtaaaaaagttacagtaagctaacgttaatttattattggaggccaggcatggtggctcacgcctctaatcccagcactttgggaggccaaggtgggtggagatcacctgagatcaggagtttgagaccagcctggccaacatggtgaaaacccatccatctctactaaaaatacaaaaattaggccaggcacggtggctcacgcctgtaatcctagcactttgggaggccgaggcgggtggattgcctgagctcaggagttcaagaccagcccgggcaacacagtgaaaccccatctctactaaaatacaaaaaattagctgggcatggcagcgtgcacctgtaatcccagctactcgggaggctgaggaaggagaattgctagaacccgggaggcagaggttgcagcgagccgatattgcaccactgtactccagcctgggcaacagagtgagactctgtctttaaagaaaaaaaaaatcagccaggcatggtggtgggcgcctgtaatcccagctactcaggaggctgaggcaggagaatcacttgaactggggaagcagaggttgcagtaaaccaagatcatgccactgcactccagcctgggcaacagagcaagactctatctcaaaaaaaaaaaaaaaatttattactggagaaagaaaaaaaaatttaaataaatttagtatagcctaagtgtacagtatttataaagtttacaatagtgtaatgtcctagaccttgacattcactcaccactcactgactcacccagagcaacttcctgtcctgtgaacttcattcatgtgcccttttatactgtatttgtactgtactttttctatgtttatatacatacttaccattctattacaattgtctatagtattcagtagagtaacatgctgtacaggtttgtagcctaggagcaataggctacaccatatagcctaggtgtgtagttggctataccatctaggtttgcttaagtacaccctatgatgtttgcacaatgatgaaatcacctaacgatgcaattctcagactatatccctgtcattaagcaatgcgtgactactgttttcctatacatacacatctatgagaattcttaattcattaaatttttaaaaatttttatttttgagacagggtcttactctgtcacccaggctgaaatgcagtggtatgatcacggttcactgcacccttgacctcccagggtcaagcaatccttcaccttggcctcccaagtagtggggactacaggcacgcaccatcatgcccagcaaatttttttttattttttgtagagacgaggtctcaccatgttgcccaggctgatcttgaacttctggggtcaagcaattctctcgcctcagcttcccaaagcactgggattaaaggcatgagccactgtgcctagccgaaaaagtttaatttataaattaggcatgggaagagattaacaacaataactaataataaagcagaacaagtataacaatatatgttatagaagttatgtgaatttgtctttttggtaagagacaggaaaaaaagaaattatgtaaatttagtgcctcaaaatatctttgtttttttagagagggggtcttactatattgcccaggctggtctcaaactcctggcctcaaacaatcctcacttccaaaaaactgggactacaggcgtgagccactgcacccagcctcaaaatatcgtatctgactgtactcacctattttcagactgcagttgaccatggataactgaaaccatggaaatcaaaactgtggataacgggggactactgtagctataataataatagtaattaggtgctcaacaattcctcaagattgctagtgtctaagggcctggcgggtaagatgtatttattcaacaggtattaatctattacctaccacatgtaaagcactgtggggaacataagatgagtaaggcatggattctgcattcaatttgtagagctgtaactgttgatgagagctaactgcaagaaagatgctgaaggtcccaaattctgtagaaggatcaagctacttcctgggcaaggcgacatttaagttaggctttgaagggtgaaaagaatttggacataggaagacaggaaaaaagacattctaggcaaagaagatgccatgtgcaatggccaggagataagaaatccagggctacatacacagaatgcagcacgcttcagttggcttttgcaagaaggcatcaagtgctgtagtgggcatgaagtgggcagtgtaagtccatagtgactctgaattcagaactgattctgcaggcactcaggccaggcgtggtggctcacacctgtgatcccaacactttgggaggccaaggcgggcagatcacctgaggtccggagtttgagaccagcctggccaacatggtgaaaccccgtttctactaaaaatacaaaaattagctggatgtgatggtgtgcgcctgtagtccacaccatcacatgcccagctactcaggaggctgaggcatgagaatcacttgaacctgggaggcagaggttgcagtgagcctagattgtgccactgcactccagcctgggagatggagcaagactctgtctcaaaaaaaagtttttaaacaaatcacacatcagcaagaaaaatgaggggaaaagctcccttactctgccatttttacctaggaacatggccatgagcttcttatcctgaagcaggatggctcctttcaccaagtactcaaagtaggagtccacgccagccccgatgcctgcgtcctgggccacccacttgccagtgagcacatcaatgtggttgccgacctgagagagagaaagacacacggtcccaacgggaaggccgatggccaaagaaggatctactcacccccaaccctgactgcccagggagatgcagggcaggtgccccagtgcttcttgggaaacatgcagaccctgagagggaagggcaatgctggatcatggccagccttcctgtacatctgcatagtagagatgcatctcatgcacatttatgaggacttaattatacacattgagcaaaaaatgaaaaagaaaaatgatttggagtgtttatgtcctgcctagagtgagtgtgagatgggagatgagaatttgctgttgccgcaatctgtctgatttctcagcacccagcatgtgattccactatctgaagacacagacgtgctttacgtatttccataaattaactcaataagaacatccaccaagaagctgacagagtggttctaaggagagaaaccgaatagctggagacaggggcaaaaggggacttcaccaatgtcactgagtacccttttttgtatcctttgacttttttttttttaattgttcagtctctgtagagactgtgaaaaattggcaatgccggccaggcgcggtggctcatgcctataatcccagcacgttgggaggctgaggggggcaaaatcactggaggtcagaagtccgagaccaacttggccaacatggtaaaaccctgtctctaataaaaacacaaaaattagccaggcatggtggtgtgtgcctataatcccagctactcaggaggcagaggcatgagaatcacttgaacccaagagggggaggttgcagtgagccgagatcgtgccactgcactccagcctgggcgacagggggagactctgtctcaaaaaaataaacaaagatacgtatttttctattttattgtatttattttattttttgtatttttagtagagacatggtttctccctgttggtcaggctggtctcgaactcccgacctcaggtgatacgcctgccttggcctcccaaagtgctgggattacaggcgtgagccactgcgcccagccaaatatatgtatttttcatatggcttagaccctcatggaagctggtaacttcatctggtactcaaagaaatagctaactgttccgcgttggtttgtgtccccccaggagcacaacctcattctgcctgaaagtagttgatttggaaggtaagtccttgtaaacaccagtagaggagggggaagtgaggcagggcaagggaggcggcatttaaggggtatgccatcaggcaggtttccaccatgggaactggagttcaatcttgctggggagcttaggaattcagtgtagagctccagcttcggagtgatcccacccaaggggcagggaactggaatgtttatccaccaactcccatcagtatcagttaccggcttgagagctactcatgggtagcattaaatcctggtaccctcagccaaaggcaagcagagtggctccaggcaccagaggagacccacaggcaaagaggcgcaggtgatggcagttggaagactggccagtgtgcatggaaatgttaagagttgagaggatatgggcatggcaccaacagagtctactacggtcccactgctggagcaaaacctgcctgagatggactaagggatttactacaggtctccagcggggcaccttttttttttttttgagatggagtttcgctcttgttgcccaggctggaatgcaatggcgcgatctcggctcatcccaacctccacctcccaggttcaggcaattctcctgcctcagcctcccaagtagctgggattacaggcatgcaccaccacgcccggctaattttgtattttttagtagagatggggtttctccatgttggtcaggctggtctcgaactcccaatctcaggtgatccgcccgcctcagtctcccaaagtgctggaattacaggcgtgagccaccgcacccagccttaggggggcaccttcttaagggattttcggggagtcctcacacaagctttacttttcaagctggattagcaccagactgcataaaatgtgcctagacctaaatgcagtcttcctaagtcagagtgactcagcaaagttggtattaatatattaacgttactgctgaagtaactgaggaccagagaggttgagtgacttgctcagggtcacacagtttcgatgtagcaaggccagggcttgaatccagttctgactaaatccagtgttatgtcctggatggctttggctcaattactgttaatcttattgattatcccatttagaagctgaaactgaccttagagatcatctggtccaaagtgtgttcaatttccatgggttaatagtactggaagataaagggaagctctggtgttaaataagtttgggaaatgttaaattaaacaaagttgaatagatttctttactagaggatttttattctgctcatgtgcattctgactctccaaaaaagggggggatattatatctaatattcccctaacttaattggccaagactcattttttcatgcaactgccactcagtatctctcagaaccggtgtcctaagaaacacagcaaatacagatagacgctaaaaatgaaggccggacgagctgatgatctgaagccgtcaagtgagtcaggggcatgaaacatacgaccctcttcctagaaatcagagaatctcaactggtcaaagctgaatgcagcccctgctgcctgccagaaacgtgctttcccactctcctccccactccaagccaaacttgaattggaggcttggtctatttttggtgtcctgagcccaaatcctggaccactcccaaggtcaccctaagttttccttggcttgactgcaacttattgctcagagccctgggcctcgtaagcagggactcaaacaggaagggcagcagcgaacctaccagcccgatatctgaccggctctcccagaggcgcatcaaagccactctggccacatcttcgaacaccgggtcaccagtgaggctgctcagggtggcaaattcaacaatgaaggtcccaatccctgccgtacaggtgacaggggtctctcctgggttcacgccatgaagtaagttcactgttccatatggcatgccagtgggggtctgaaaggctgaacaatcgacaaattatgatcccggacaggagcagggggatagggatagttctgatacacgcccaaagcctgggaccttagccagcacttccctctttctcctgggtatcctgctagagtctgagccagagaaagataaatgtcataactggagggccctgagcagccacccagcccagatgctgtcaaacactgctctgcataaccttgggttcctgctcatcatgagggggcagggagcaggctgtgctccacacacactcgctttagctagagagctttacctatttttatttattttacactacgccttcaaagcccaggcaggtaacttattgtgatgcaggcagggtttaagccacagaaagtggtggggcttgtggcacaatgacaagagtaagccccgttcaaagccattcatagacttttggctcacgcctataatcccagcactctgggtggccaaggcaggcagatcacttgaggccaggagttcgagaccagcctggccaacatggtgaaaccctatttctactaaaaatacaaaaattaggcaagcgtggtggtgcacgcctgtaattctggctatctgggagactgaggcacgagaatcgtttgaacccaagaggcgtgggctgcagtgagctgagattgcaccactgcactccagcctgggtgacagagcgagaccctgtctcaaaataataataataataaacaaagccattcatagactttaaataaagatctctgctttaaataaagagtataggggctaaattatttttaaagggaagcaaaataggatataaaccactaaaccacggatatagtatgaccctcgatttataggtagggaaaaccatgcctgtaaagaagtaattcagccacaggtcacacagagagagtcaaacagagctgggatgggaacgcctcccctgtgcccaccccagccccagtccagttctctgcccgccccacccaagtggcacccaagtgccttctggttcaagacgagaactggacaaccagccagaggcagagatttcctctctgggcctaaaggtcaaacaactccagagcagcctatgcgtcaccaaactgtgaacaaaggtgtcgacacttccaagaaccacagggtctagcaactgtgtctgccacagacaagaaacttgcaatctggcaggcaccagcgggagagcaagtcacaaccaggaagggctctaagcaatatttcagaaaaagtcaggctgtaataaaaagaagaggagtgacaaaatcctgtttcttgacctttttttataaaatgaccaatgaccaaaaataattaaattataaaggaggagcagctaggcagagtttccagagtttcctccagggatgaatcacacaggacacaatgtctgcaaggagacgctcaagccatgagccatgagccatgagtgagacctgaacctagctcacccgctatcctcagctctcccccaaaggagaggcaagtgctatgtgagaaggataaagaggccgggtgtggtggctcacgcctgtaatcccaacactttgggagtccaaggcagatggatcacttgatcccgggagttcaagaccagcctgggcaacatggtgaaaccccatctctacaaaaaaaaatttagccatgcatggtggcatctgcctgtaatcccagctactcaggaggctgaggtgggagaatcaactgagcccagaagttcgagaggctgcagtgagccatgatcacgccactgcactccagcctgggcgacagagcaagaccctgtctgaaaaaaaaaaaaaaaaaaaaattaagaaagaaaagggataaataagtgagatggccaagaggtgatggaaagcacagtgtgacgtgtctgggtgtgaacagtcctcagagcctccaccacaccctgaagggaacacagtgtacagttgatgctactgagcctggtgttactgccccactagacaaaaacatggaggcttgacctgcagccctggacacagcttagccacaaaacaaatccctctcgttttaaaagtgttggacgttctctaagcagtttctccttcctgacctcattttagcctctccaaaacccgatgtggtagggaagtagaaattatgattctcatttgatagatggggaaaccaaactgtggagagaggccagacacagtggctcatgcctgtaatcccagcactttgggaggccgaggcagccagatcacttgaggtcaagagtttgagaccagcctgatcaacgtggcgaaacttcatctctactaaaaaatacaaaaattagctgggcatggtggcaggcgcctgtaatcccagctactcaagaggctgaagcaaaagaattgcttgaacccaggaggcggtggttacagtgacttgagattgtgccactgcactccagcctgggcgacagaacaagactccatcacaaacaaacaaacaacaaactatgaagagaaagagtggcttggtcacgatgttggctggcagagctgagtctagaatccagggctgctaatgctcacaccaacacccttccctgggcccctgttactccagcagtgtgtggaataactgtagtacctggaaggggacaaatgggctcattcaaaataagggtaatggccttccacccaccaggctggccaccttcaaccatcccctgcaaacaataatgaggtcaactcatccatccgggtcagggccccagcaggcccttaaaatgcccaggacactcctgatttccatggtgggtgcctggtgggtagaaagaccaaatacacctggtgagaaataccaggaattaattcagcactgccactctcatcttcagcaagggaagcaggacctactggacttcgtctctgccccatctctgtgtgggtcttacctgggaggagttttcgggccgcctcctcagccattctcaggagaggcccggaacagggccatccagcctctacttccaccccagccttcttggagagcagatgagcagacaggagtcctcctaccactacagatggcacagaaagcaaatggcacagtccaaagggaaagaccaagggatcaaggatctttcccctgtgcgagttaaacataaacactctattgtggggcgcatgttctcaggacctcctgaagctatttcacgggtaaaaacaaacaaacaaaaacctcactctgttggggtggctcactgggaaggagctagagccacccagcgaaaaaagagtcccttaatcccacatatttctatggtgttaagtttatggggttttcttctcttggttcatcacaggaacagtggctattttttgtaagtccctattgtgtaccaagcactaagtactactgtcccctcttcgtatgaagatactgaggttccatgagataaagtgacttgccccaggtcacccatctagtaggtggtagggctgagtatctttgattccaaagcccatgctcattccatttgtcactctgtctgtctcccagtcacctgtcatacctggggggaaggggtaatgatggttattacctttattttactaatttatctatttcaacttattatgcaatatgtagaactttttttttttttttttgagacggagtctcgctctgtcacctaggctggagtgcagtggcgcgatttcggctcactgcaagctccgcctcccaggttcacgccgttctcctgcctcagcctcccgagtagctgggactacaggagctcaccaccatgcccggctaatttttttggattttttttttgtagacacggtgtttcactgtgctagccaggatggtctcgatctcctgacctcatgatccacctgcctcagcctcccaaagtgctggatttacaggcatgagccaccgcacccggcctacttagaacttttaaaaagacacaaaggttcttggaaatacagctaaatagatatcctgagtggccctctcaatgaaaataactggtgaccctaagtttcaaaattcccctcctccctgcagagggggaataggagaccaaggtcagacctgccccaagtggaagtctgataaaaggtccctatgcaggccaggcatggtggctcacatctgtaatcccagcactttgggagccgaggtggagatcacgaggtcaggagatggagaccatcccggctaaaatggtgaaaccctgtctctactaaaaatacaaaatattagctgggcgtggtggcaagcgcctgcagtcccagctacttgggaagctgaggcagaagaatggcttaaacccaggaggtggaggttgcagtgagccaagattgcaccactgcacttcagcctgggtgacagagtgagactccgtctcaaaaaaaaaaaaaaaaagtctgggcacggtggctcatgcctgtaatcccagcactttgggaggctgaggcaggtggactgcctgagctcaggagttcgtgaccagcctggtaaacacggtgaaaccctgtctctattaaaaatacaaaaaattagccgggcatggcgttgtgcgcctgtagtcccagctactcgggaggctgaggcaggagaattgcttgaacccaggaggcggaggttgcagtgagctgagatcatgacactgcactccagcctgggcgacagagcgagactccatctcagaaaaaaaaaaaaaaagaaaagaaagaaagaaaagaaatctacatgtatgtaccttatggtaaaactgcagaacaccaaagggaaaaatgatctcgaatgcagccagaatccatgtaataataattattaatgctgggtgatgggcacgtctggttcattatgctattttctctacttttatgtttgaagttttccataacaaaaagtttttaaaaggagaagacagccaaagtgaaaaccaaaacaagattctctacaaataaataataattacattgacagattacttcttaacaataatgaaaccagaagataatggaaaaagtttttaacacaataagagaaagtaaccatcaacctagaaccatacacccagcaaaaatatcactcaaaggccaaccaaaggcagttgaataaagacattttcatataaacaaaagctgggaatgtttatgaagcacacacctgcattaaaggaaattctaaaggaaatactttagagaaaaggtctgagacacgaaaagaaaaaatagtcaaaaaagtggtaaataggccaggcacagtggctaaacctgtaattccagcactttgggaagccaaagcaggtggatcactcaagatcatgagtttgagaccagcctggccaatgtggtgaaacaccatctctactaaaaatacaaaaattagcctggtgtggtggtgcacaactgtaatcccagctactctggaggctgaggcaggagaatcgtttaaacccaggaggtggaggtgagccaagatcgcgccactgcactccagcctgggtggcagagtgagactctatttcaaaccaacaacaacaaaaaaagtggtaaatttatgtgtaaatgcaaaacttcaacaatatagaacaaaaattataatgtatggaaggtttaaaacaaataactaaaatatataactgtagcatataggtcaggatgttctctaagtcaggttttgcattattcaggaggagaacaaagattttcattaaatttagactttgataagttatgtttgttaaatttgcttggaaaactatgtaaaaagctagatattgtgcataatttccatattagtaagaggaaaatggaatggggggaaaacaatctaaagaaggcatgaaaaaggacagaataaaggaacataaagaagatggcacagggccaggtgcagtggctcacacctataatcccagcactttgggaggctgatggggggcggatcacctgaggtcaggagttcgagactagcctggccaacatggtgaaaccccatctctactaaaaatacaaaaattagcagggcacggtggcaggcacctgcaatcccagctacataggaggctgagacaggagaatcgcctgaacccgggaggcagaggttgcagtaagccaagattgcaccactacactcccgcctgggcgacagagtgagactccgcctcaaaaaaaaaaaaaaaaaaaaaaaaaagaagacggcacagagagcacaatactgtagaaatgagtgcaaatatatcagtaattacagtaaatgtaaatggattaaatgtgccagttaaagattgtcagaatggataaacaaaatataatacactatttgcaaaagatgtatctaatcataaaactacagaaagatggaaaggatagaaaaagatacatgggaaaatgtcaaccaaaagaaagctggtatcacttatattcctatcagaaataaaggtataagaatgaccttcatttacagatgacaaactgggctcagaagctgggagacatagcagcaagtacagcctcaaactcaggccggattcctaaaccaggattttagaccatgttgtccctctgctctcttctcttttttaatcttttatggatcatatgtctggaatataagtttcattgcagaaaacatacaaaataatggggaaaaatagaactctgccatccagaggtgacagctgttaagtggtctagaggttcgatgcaaataagggctgtgctggcttcacaagaatcactggaagtctgctaaaaatactgattctaggacccaacacagagattccaattcattaggtttagggtggagtctcaacatctgaattttttaaccacttgggagtggttcctatgggctgccaagtttggaagattaatgctgtagatttgcactgtccaatacaataatcactaactacatgtgactacttaaatttaatatcattaaaattaaatgaaattaaaaattcaattccatagttgtagtagatacatttcaaatgctcaatagctcatgtggttcgtggctaccatactggacaaaacacagctataagacatttccatcactgcagaaaattggattggacagacaataagttccaagaaggcaaggatcatatctttcttgttcatagctgtatgcctagtatcaaatacatattaaagaggtgagtaatctggtgtatttctttccagtctcttagtctcctgctcactttcatatctgaaactgatggggaaatcctgagacttccccacctcaccctccaggagggaagaagagctctgtcggtcagaggttttggccaagggtcctggcatggtcagtccttaaaatcctatttaccacttcttggtttacagaggcaacttcacactcttttttcttttaaaggtcctagagagcagcccttacctcgaatgtttgtttcaaacacagaggcgttcacatcaatatcaaagtccacgctgtcctggagcacttcaaccactctttggaattctgagacattccccaaaatctggaaataaaaaagagacctgacaatgaggctcttacatgcatggaggcagattcagagtctgggatcctatgttgatgtggccctcactaattccacttaagacctccagtttctgtcctaggattggtgacagcagaagaaaacactgagagctagaaatcatctagagacttcataccaagagactggttaagtaaattcctaggtcccaattaagagtcacgatgttgtcatttaaatggacacaatataaagaacgcaaactacgcatagaagtcttaggttttttgtttcgtttttttgagacagagtctcgctctgctgcccagggtagagtgcagtggcgtgatcttggctcacttcaaactccgcctcctgggttcaagcgattctcctgcctcagccccgagtagctgggattatgcaccaccatgcccggctaatttttgtatttttagtagagacggggtttcaccatgttgatcaggctggtctcaaactcctgacctcatgatccacccgccttggcctcccaaagtgctgggattacaggtgtgagcgaccgcacctggccaaaagtcttagtttgacatttgcagtagataccagttgtcaccttcaaccttgtggaaaacagaacaggttggttggcccaaaacaaattcattcctaccctctttacctcatggcctcccaccagaggttggaaatccagaagctttctcggcctcctttgctgctgcagttgattgtgttacccagtcaattctgacccttgagaggtctactgggggcacttctgggaaggcttctgttttcttaataccaagggacaaacacagctaacatggcttttagtctctctctttctgccttgaactcagactcgatttctgaagtgatggcagctatgtgagaccatgacgtactaagcattagaataaaagccaaaacactaacgatactagaatgcaaagctacaaagaggctggtctctaatgacacagttgcgtagctgacccaatgctagaaattacctctagactttcttttacttgagaaaataaaccctctttatttaaaccgttagccaaatgcaatctcaatctctcttcttttgatagtaacatctcaatttaccctcgaggaatcactcttccccggcagtcactcctgtggtttgggagaggctgatcccatccctctagctgtggagtgggtacttgacctgaaccagtccaagtcttttttttgagacagggtcttgctctgttacacaggttggagtgcagtggtgtgatcatagctcatcacagcctcgaactctgggacttgagcaatgttggcctcccaaagtgctgggattacaggcatgagccaccacacctggccctttttacctttctaagcatcaggtttcttttatatcttttttttgtttgtgtgagacagggttttactctgttacccagaccagagtgcagtggtgcgatctcggctcactgcaacctctgcctccctgactcaaacaatcctcctacctcaccctcctccctaacaaatggagccacagacatgtgccatcatgcctaattttttatatttttggtagagacggggtttcaccatattgcccaggctggtcttgaactcctgtgctcaagcagtcctgccgccttggcctcccaaagtgctgggattacaggcgtgagccactgtgcccatccctaagcatcaggtttcttaacgataagaaggagtaaaggtactaacctcaagaagttgttagaagaattaatacatgtctgtactaagccctacagaaacatactaactagtcactgatattatttctttataattttttttgagatgaagtttcactcttgtcacccaggctggagtgcaatggtgcaatctcggctcactgcaacctccgcctcccgggttcaggcaattctcctgcctcagcctctccagtagctgggataacagacatgtgccactatgctgggctaattttttgtattttaatagagatggagtttcaccatattggccaggctggtctcaaacccctgacctcaggtgatctgcctgcctcggccttccaaagtgctgggattacaggtgtgagccaccatgctcagcctgatacccttttattatcattgaacatggccactagaatgtaagcctctgaaaacaggagatgtcaaagtctctgtatcccccatagagctatgcaagcctatcacaattctccgtacataacaggtcctctataaatgtttgctaaataaatgaatctgcataagttgtagttcgtttttcccctatctagctaggcaaccacagccggacgcttcagaatcatgagatgcaaataaaaggcctaggagaggaattcatttttcacccacagtcacgctgccaaaagaggaaggatgttggttatgtaacagtggaaaggaaaagaaacagacgagatacttaccagcaaggtgtccagtgcatcaattagagtcagagaaaaactgcaaaaggacagaaatcccagccgcttagtaagaaaatcaaataccagatattatggctgccctagatctgatccccctaaaactaaatgaggcaaagtaatgcctctgcctgtcccacttacagtcacaacagagaaaccacagtgaaaatcgcaggtattctctgacccacttaatgcacctgggagggttggctgatgtagctcaattgtaattaaatacatcacctatagtctggcattctcctctaccattgggaggcagtataagattgcagcttaaagcacaggcctttcaccaattttcacctctaggaatttaattcacagtgaacagctgtttgagagtgttcatggcagtattgcttagaacagcaagaggctggaaagaacccaactgtccacccattaatgggtgattaaactgtgttataaacagtgcaaaactatgagttatcaaaaagattgttatcaagacttctatgtgctgatggaaagacattcgaattgtttttaatgaaaaagtcagggtggtttagtatgtttccatctgtttcaaaaagacatgctgacagaaagcagacagcaattgttagggtcagtggtggtgcagggatgaactataaagggccacaagggaactttttaaagtgacagaagtgtttcatatcttgactgtgatggtggtcacttcaaacgagtgtaggctgggcacagtggctcatgcctgtaatccgccagcactttgggaggcctaggtgggtggatcacctgaggtcaggagttcaagaccagcctggccaaatgacaaaaccccgtctccacaaaaaaattagccgggtgtggtggtgggctcctgtaatcccaactacttgggaggctgaggcaggagaatcgcttgaagccaggaggcggagtttgaagtgagccaagatcacgccattgcactccagcctgggtaacaagagcgaaactccatctcaaaaaaaaaaaaaaaaaaaaaagagtgtattttattatatgtaaattatgcctttaagaagttcattttaaaaagatacacatacacacatctatatatataatggtataaaccaagaatatttctggacagatacaaaggaaagttaatagttggaattctagggtatgggagatatttattgtatataatcttttaccacttgaatttgccatttgtatttactttgtttcaacttaaaaaaataaaaaccatcacaagttttgagtttaatttctcccgaccttagcacattcgtgtgtaaaacagggataatggcacctaactcgtaggggtattaagatactgagctgagatctgaatgacaagcagcagccagtgatgggaggaaaatggggagtgtatttcaggcacggggcacaccaactacaaagacttaagttttaggagtgtcacactccttcctggatctgaatgcccacctacataatgaaaggggtgggttttctaattcttggagcccttccacggtatctcgttactccagaaattgcctatgtccccacagctgatgcctgttactgctggggctgagctcagcgatccagcccacccggctaatccaggactttttttttcactgcgagaggctaagtggatcctggaggtgatagtaagaattgcggggagcgcggctctagctcagctgggagctttctggtgccggtgaggagaccatgaagccaccagccccagctgacccgcccgccgaggcccagagagtcagaccctggccgccccttgcccctccgctcgcactacctgccccaggtgtcgtgcccgtcacaggtgagaggtcgcagctcatcgaagggaaaggcattctccaggtagctgtcgtaggcgtggtagaacatggccttgactcgctccctgggtgggggacgagaaatcaggcatggggcaagaacacaaaaacaagcgggggaagaacaagatacagggcggaaagtgggaatcactagctgatttctccctgggacctagcggctgtgtcggagcaagtcggggtctgggatggacggaaagggaaaggaccgggttcacgcttcccattccccaactgcgaaagggcgggtcacagttcacctgtagtgggcgggatctggcgcggagccgtcgggacctggcgcaccatggtgctgaggcagcagcgcgcacaggaggccgagcgggatgagcagccggaaaggcatagagctcgtgtcctctcagcgcccccgcagcagcagcagccactgcaaccagttcatcctgggagctgctgcgggttcttccgggaatccgcgccactgcgcctgcgcgctgagaaatcagcctctcacttccggactacaagcccctgaatgcaatgggcagcgaaacgcggccgaagagcaacttcggatgtacggtttcggcaacactgatcaacgtgtcttaaagtcagtggctgttgttactactgttattaattaatgttttaataataacagctagcatgtattgagcacttattgtgtactagtactgtacggagcatttaaaatgcattctctcattcatttttttcaacaaccttattaagtatgaaggcagggtaagcatgagaaatgttcagcctttaccattattacctagcaggacaagccgcagacaaaactcctcagacaccgggttaaagaaggaaggagctttattcggccgggagcgtcagctgactcacttctcaaaaacggagctccccgagtgagcaattcctgtcccttttaagagcttacaactctaagggggtccgcgtgagagggtcgtgattgattgagcaagcagggggtacgtgactgattaccggtgcaccggtaatcagaacggaacagaacaggacagggattttcacaatgcttttccatacaatgtctggaatctatagataatataaccggttaggtcaggaggggtcgatctttaattaccaggcctggaatgcatcgccgggctgtctgactactgatttcacttctgtctttcttttaactcctacattttctttgaggcagaaattgggcataagacaatatgaggggtggtctgctcccttatttagggatattgagtttcccaaaccagttacttgttgattgtataagacacaactcacatttatttgtccaaaacttccactcttttttttttaaaacctcttgcattttccgatgctgtcactcttgaggtttcctgaaatcccgtcagttctaggaattcatgacacttctctcctcccaatttgggatgtggttacacaatcatggtcccttcagtctccatctcaaaccggaagctttacccctgtcagccctgtagaatgtcttgggtaagaatgaataccctggttgggcgcggtggctcacgcctgtaatcccaacactttgggaggttgaggtgcgtggatcacctgaggttaagagatagagaccaacctggccaacatggtgaaaccccgtctttactaaaaatacaaaaattagccaggggtggtggcgggtgcctgtaaatcccggctactcggaaggctgaggccggagaatcgcttgaaaccggaaggcggaggttgcagtgagcgaggatcgcgccactccactccagcctgggcaaaacagcaaaactccatatcaaaaaaaaaaaaaaaaaaaaaaaaaaaaagacaaatgactaccctggggcactatagctttcaggaggtttgtgatccatttctccattccccttattcccaagtttctaaaatttggtcagcaccttagaccacagcaacacccatgactttggtcagtgtgacatgcggtagaaccaacactggatttgaagtcagatctaggatccagttaattacaactctgtcactcatctataacctgtgtatgtgaccctctccttctctggggctagcatccttgtctataaataatgaggagtttgaacaaatggatctttaagatccttttcggtcgagctttctatgattctaggattggctatctcttatttgctgaaaaagtcagatggaagtgatagctcagtttgttgagccagagtgcagccaggcctcccaaagtgctgggattacaggcataagccactgtacccagcctgggatgtttttagaaactcttcttggccgggtgcagtggctcacgcctgtaatcccagcactttgggaggccaaggcgggcggatcacgaggtcaggagttcaagaccaacctggccaatatggtgaaaccctgtctctactaaaaatacaaaaattggccgggagtggtggcagacgcctgtagtcccagctactcaggaggctgaggcaggagaatcgcttgaacccgggaggtggaggttgtagtgagccaagatcaagatcaggccactgcactccagcctgggagacagagcgatactctgtctcaaaaaaaaaaaaaaaaaagaaactcttcttggggcttccaaatggaagggaaaggagatgacagtaagctgagacctggataacaacacaggagcactgtattcgtttcctgtgattcctgcaacaaattaccacaaaccaagtggcttaaagcaacagaaatttattctctcgcagtttgggaggtcaggagcctgaaatcaatttcactgggctaaaattaagttattgacagggccacacccactccaaaggctctaagggataatccgttccttgcctctctagattctcctgactgctggcattccttggcttatggttgtatcactccagtatctgcccgtgccttcatatcgccttctctgtggatgtgtcacatctccttctgcttttctcttataaggacatttataattgcatttaggaccccccccgcgccccccccaacccagataatacaggataaactcccattccaagatttttaacttaatcacatctagggggaaaaaaaaaaaaaaacaccatttttccaaatagagaaacatttacagtttccagagattaggacctggactttaggtggctgtttccagcctagcgcagggactaaatatttttcagacctgggcctttccctgtgacgaaattcaccttctccatattataaatcctatagcttatctttttgtctcccattcaaaattctagtgtggataaaacttttgcaggaagggtgggttcaggttgcctggatttggtaacgataggtctctctttatgagcaagattgaaacactcatgattttcctttatattctttttctagcttgatgtcattctccacactgtcactgaacaaataaaaccatgacttacgttttcacaattcatgtgactatatgttctctaatgagaataaaaaaattgttttaccctctggaaagtatcaggactcttctttctctcactctgtgtttatgatattggattctagaaggttatgacccaccagtgaagtgtcacacttgagcatttacttgtgaagagactcagggtaagttgcctacctctctgagactcaatttcctattgtaaaatacagaaattgatgaggccataaaggaattctgggaattaaatgggataatgaaagtgaacattctcagcacagtgactggtatatattaaattcttgatacatattaattctcttccctgcctccccaactcttcttttttttttaaggcagggcagttgtttccatttactgagcatctgccccgagtcatccaaggtgttataggcaatagttcctaccctcaaaagtttgaggcacagtgctgagcatataactaagattccaaaataatcaagtcatagtcctttcccttgaagtgcttgcaattttgttagaaggggaagatgtcaattggagaatacttggaatcatagggtgttcaagtcttccctgtgggtgaatagagtttggagggagctcagatcacatcagtatctgaggccaatgtcctcggactctgtgttcagtggaacaagacttggactggttgtcggaaacccttggtcttgttacttgtttatccactatctctgtgtgatctcgggcaagtcattttcccttttggggactcagtttccatatctggaagatgaaagagtgagactatctctcagcacaaggaaaatattaacagatccatacagttattgcaaaaaatcagaaaacagaattcaacacacatcgactgcacaaatttcccccagaaacatccatgaagcagaataaaacagtgggacagcattccaaatggaatttgactatttgccaactaaacaaggaagaggagggggatggggagggggacaagaagaagaaggagaaaatagtcacgtgtattgataatagcgaacatttacatagcaagtaatgttctttgtactttacatccatcaacaccattaatccttaccacaaccctctgagaaagtgtcattatcaccattttataaaccaaaaacctgaagcacagattctaagaattgaagaaagatttagcaacttaatcaatgtctcataccgaataagtagaagagtcaagatatggacccaaacagcctatactctaacgcattaatgaaaataatgacaaatatataaataaaaggccaacacagaattcaacaatggagatctggcgaactgctacagtgtcctctagctttagcttcatgtggttttagggtcaacatttccttcccttttgctagaaagttagagggaaaagctcagttccctgaagttggaagccaaggcattttagatcccctttggccaagtacactcgacctcttttagcagggaagaatcctttttgtagcatctggaggtcatttggttctcccaactcccaaagcagggcttgcacaatacatacttttgacttgccaaaaaataagtttatccctgggaaatttcccatccatctgttgctttgtagaaatgcttgaactttgcatgcagtatgtccaaacatttcgatcgactccctggttagagtctcagacctcgttattattattattattatttgagatgagagttttactctcgtcacccaggccatagtgcagtggcgcgatcttggctcaccacaacctccacttcctgggttcaagtgattctcctgcctcagcctcccgagtagctgggattacaggcatgcgccactatgcccggctaatttttatatttgtggtagagacagggtttcgccatgttggctaggctggtctcgaactcctgacctcaggtgatccgcccacctcagcctcccaaggtgttgggattacaggcattagccaccgtgcctgaccttacacttttattcttattttatttttcttctttttgagatagggtctcgctctgtcacctaggcactatcaccactcacttcagcctcgacttcccaggctcaagtgatctttccacctcagcctcccaagcagctgggaccacagatgcgtgacactatgcccagctaatttttaatttttttgtagagacaaagtctcgctgtattgccgaggccggtcttgaactcctgggctcaagcaatcctaccgccttggtctcccaaagtgtagagattacagaaatgagccaccacacctggcctcagaccacgtttttattatgctcatattccaagtgaactcagacctgtagctaaatctgccacagaattgtgcactttaaaatggttcagatggtaagttgtgtcacaagtattttgtcacaatttcttaaaaattaaaaagtgagccctctccctctccctctccctctccctctccctctccctctccgtctccccacggtctccctctcatgcggagccgaagctggactgtactgctgccatctcggctcactgcaacctccctgcctgattctcctgcctcagtctgccgaatgcctgcgattgcaggcacgtgccgccacgcctgactggttttggtggagacggggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcgctacaacctacacctcccagccgcctgccttggcctccctaagtgccgagattgcagcctctgcccggccgccaccccatctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagagtctctgcccggccgcccatcgtctgagatgtggggagcgcctctgccccgccgccccatctgggatgtgagagcgcctctgcccggccgagaccccgtctgggaggtgaggagcgtctctgcccggccgccccatctgagaagtgaggagaccctctgcctggcaaccgccccgtctgagaagtgaggagcccctccgcccggcagctgcccctactgggaagtgaggagcccctcagcccggccagccaccccgtccgggagggagatgggggggtcagcccccccacccggccagccgccccgtccgggagggaggtgggggggtcagccccccacatggccagccgccccgtccgggagggaggtgggggggtcagccctccgcccggccagccgccccgtctgggaggtgaggggcgcctctgcccggccgcccctactgggaagtgaggagcccctctgcccggccagccgccccatccgggagggaggtgggggggtcggccccccgcccggccagccgccccgtccgggagggaggtgggggtgtcagctccccgcccggccagccgccccgtccgggagggaggtgggggggtcagccccccgcccggccagccgccccgtccgggagggaggtggggggggtcagcccccctgcccagccagccgccccgtccgggaggtgaggggcgcctctgcccggccgcccctactgggaagtgaggagcccctctgcccggccagccgccccgtccgggagggaggtgggggggtcggccccccgcccggccagccgccccgtctggtgggggtgtcagccccccgcccggccagccgccccgtccgggagggaggtgggggggtcagccccccgcccggccagccgccccgtcagggagggaggtgggggggtcagccccccgcccggccagccgccccgtccgggagtgaggtggggggggtcagcccccctgcccggccagccgccccgtccgggaggtgaggggcgcctctgcccggccgcccctactgggaagtgaggagcccctctgcccggccaccaccccgtctgggaggtgtgcccaacagctcattgagaacgggccaggatgacaatggcagctttgtgggatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctccctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaatttaaaattaaaaaaaaaaaaaaattaaaaagtgaggctgggcacagtgcctcaagcctgtaattccagcactttgggaggctgaggcgggtggattgcttgagcccaggaatttgagaccagcttgggcaacatggcaaaaccctgtcactacaaaaaaaaaaaaattagcagggtgttgtggcatgtgtccataatcccagctactcaggaggctgaggtgggagggtggaataaatggaatgtgatccaacaaaattattattattattattttgatgatgtctattgcccttttgaaatacccaattctggcagggtgcagtggttcacgcctataatcccagcactttgggaggccgaggtgggcagatcacctgaggtcaggagtttgagagcagcctggccaacaaaccccatctctactaaaaatacaaaaattagccagctgtgttggtgagcgcctgtaatcccagctacttgggaggctgaggcatgagaattgcttgaacctgggaggtggaggttgcagtgagccgagatcatgccactgcactccagccagggtgacagagcgagactctgtctcaaaagaaaaaaaaaaaaaaaaaagaaatacccaattctttcacagaaaatatgttcttactggctggcggggagaggggtggttggtaaatgggaaaagggtgcttcctttgctgatatccaaagcagatactttctctgcctatttgatgatacaaaactagccctaccacaccaggctaagggagagaagaggatccgtgtcctacagaattccccctattagcctacctgccccatagcccccaaactctgctgctaatcaactgtgccaggtcaggaagaaagaaactggagggaaagaagaagcctaatagattgaaaatcccttcagcaaacattttttgagagccttataactgttagtgtctactgaattaaacttactagtgttaagaaaaattatctgaaacatgttactaaggtaaaaagatgattgtgtgactttttgctgtcatgataaagcattgactagcaagtctacttgtcatctgtccctgaagagaaacgtgacactattttcatattaattacggcccagacattgtacaattctgtaaagtaataagatgtgacaatttcctttcctgcctggtagagaagataatcccaaaggttatgatattattactctgtaggacattaacccatttagtatttaatttagcaatcttacttcaatattttccttttccattgactataaaaactcaagttcttttttcttttttttgagacaggtctcacattgttgcccaggctggagtgcagtggttcgaacacggctcactacagtcttgacctcccacatcccaggctcaagtgatcttgcctcagtccctcaagtagctgggactataggcatgtgccaccatggccagctaatttttgtatcttttcgtatagacggggttttgccatgttgcgcaggctggtctcaaactcctggctaagcgatccacccaccttggcctcccaaagtgctgggattacagatgtaatcccaccatgcccagccaaaactctagttcttatattctattttgaactggctttgtcgtcctgcttgtcccttcattaatgagttaaatgaaactctgacccatgctcactgtctatttcaatgagaattatggttggttttgtttgtttgtttgtttgttttgagacagagtctcgctccgttgcccaggctggagtgcagtggtgtgatcttggctcactgcaatccccgcctcccagattcaaatgattcttttgcctcagcctcccaagtagctgggattacaggcacctgccaccactcccagctaatttttgtatttttagtagagacggggtttcatcacgttggctagactggtcttgaactcctgacttcaagtgatccatccactttggcctcccaaagtgccgggatttacaggagtgagccactgcgcctggccaagaattacatttttaacatgctgacagttgtccttgacactaagtgtcagaccctggattaagtaatttatagacccatgatactcctttgagatagtttttgtccccattttccagatgagaaagtgaaggcacaaaaagataaaagaaattttctcagtgccagttttgtgccaggagctttactaagttacagtttttttctccttccctcgaagtcctgtttatctattcattgattaaaaaaaaaaaaatcattgagtacttacgatgtgccaaatactctgctaagctggtaatacagaactttaaaacacattctctgccctcttatggcttttggtgtggaagacagatgcataaatagacaattatcatttaaagaagtaagggaggaaaactctctgaacttattctggtttgggggctgcctgcaaaaaaattaattaatgaattaattaattaaaaattaaaaaaaataaaaagaactaagggaaagagagggctccagtagaacagagggagcatctaaccctggcttgtggacatgaagtcagggaaggcttcctgtagtaggtgacacctgagtattctaataggaattagtagggctgaagaaggtggtgggaagcacctcaattcaaaattttgattcctttgtgtattatgaaaggctcttctgactcctgcttacctcctcatatcacttcttccttcctatcacctactcctatttggccatacttaagtattactgctttctcaagtatgttatattctctctcctttcctattatattcttttgtaccttcttcaccctgtacttgaaacaactttttcctcacccctacttgccccttaggcattatcggggttttttgtttttgtttttttctttgtttgtttgtttttgagacagggtcttgctctgtcacccaggctggagtgcagtggtgcgatctcagctcactgcagcctcagcctcctgggctcaagtgatcctcccacctcagcctcccgagttgctaggactacaggcacacgtcaccacgcctggctaatttttgtattttttgcagagcccagatgaactcctgggctcaagcaatcctcccacctcagcctcccaaagtgctgggattacaggtatgagccaccggacccggcctggaaagcattcctttttaaaccaggaaaatggcaagaatattctcttatattctctatcactttttttttttttttttcctggagacagagtcttgctctgttgcccaggctggagtgcagtggcacgatctcggctcactgcagcctccgcctcctgggttcaaacgattctcctgcctcagcctcctgagtagctgggattacaggcatgcaccaccacacccagctaatttttgtatttttagtagagatggggtttcaccatattggccaggctggtttcaaactcctggcctcgagtgatccacccacctcggcctcccaaaatgctgggattacaggcgtgagccactgtgcctggccttctattactatctctgttaaacattgtactagaggttatagccagaacaataagttgaaacaaacattataaaaattaaaaaagaagaaataatctgtcattatctattggtgctatgaatatgcatgtagaaaatccaaaagagtctaaaaataattattataacaaacaaaagaatttattaaggttgctagaaacaaaactaatgcaacaaaatcatcagtacttctatatgctgagaataagcacaccatgagatttaaaaaaaaattatttgcaataatatttttaaaatatggagaacttgactgggtgcagtggctcatgcctgtaatcccagcactttgggaggccaaggcgggcagatcacttgaggtcagagtttgagaccagcctggccaacatggtgaaaccctgtctctactaaaaatacaattagactggtatggtggtgtgtgcctgtaaccccagctactctggaggctgaggcaggaaaattgcttgaatctgggaggtggaggttgcagtgagccaagattgtgccattgcactccagcctgggcaacagagcaagactctgtctcaaaaaatatatatacgtatgtatatatgaagaacttagaggggaaaacttaacagaggatgggccatatgttcagagagaaaattatgaaactctgagagataccaaaaaagatgtaaacaaatgaaaaaaatacaccctatcatgcactggatgattcaatattgtgaagatgtcaattcttcccagtcatttacatgctaaatgcaataccaaccaaaacttcatcaacgtgataaaaaagattccaaaatttaggtgtagacgttcaaatattcaaaaatagctaagacactcttgaagaacaaagaggaaaggcttgatctacaagatataaatacattatgaaataatactaatcgagggccaggcactgtggctcacgcctgtaatcccagcactttggaaggccaaggcaggtggatcacctgaggtcaggagttcgcgagcagcctgaccaatatggagaaaccccgtctctactaaaaacacaaaattagccgggtgtcatggcgtgtgcctgtaatcccagctactcgggaggctgaggcaggagaatctcttgaacccgggaggcagaggttgcggtgagctaagatcctgccattgcactccagcctgggcaacaagagtgaaacaccgtctcaaaaaaaaaaaaaaaaaaagagaaaaaaaaatttaaaaaaaaaagaaataatactaattgagataatgagcattggtaccaggtgagacaactggaccactgaaacagaatagacatatttactgtaagtcagagatgccactgcagatcagtaaggaaaggccaacttttgataactggttctgtctgggacagtggatatccattaaaagaaactaatcttgacctccacttcataccatacctcaaggtgaaagacaaaactaaaaagctttgaacataaacagaatatcttcatgaccttggggtttagggaagggttgcttaaataaggcacaaaaagtacaaactgtaaaggaataggttgataaacataaccaccttaaaattaggaacttttgtttatctaaagacatgataaagaaagtgcaaagcggctgggcgcggtggctcatgcctgcaatcccagcactttgggaggctaaggtgggaggatcacttgagcccagaagtttgagaccagcctgggcagcatagcaagacctcatctctacaaaaataaggttttttaaaaaaaaaaaaactgtgacggttaaaccacctactcaagactcagcaatggtggatgccctacgacacctaggtggcgtagcctactatacccctaggctccttggtatagcctattgctcctaggctacaaacctgtagaacatgttatgatcctgaatactttaggcaactgtaacacaacggaaatatttgtgcatcttaagaaatctaggatttgctggcaagatggccaaataggaagagctctggtctgcagctcccagtgagatcgatgcagaaggtgggtgatttctgcatttccaactgaggtacccggtttatctaattgggactggatgggcaatgggtgcagcccacggagggcaagccgaagcagggtggggcgtcgcatcacccaggaagtgcaagaggttaggggatatcccccctagccaagggaagcggtgagggactgtgccctgggaaatggtgcactacggcccagatactgcgcttttcccaaggtcttcgccacctgtagaccaggagattccctctggtgcctacgccaccagggccctgggtttcaagcacaaaactgggcggccatttgggcagacaccgagctagctgcaggagttttcttttttttttttcataccccagtggtgcgtggaacgccagcaagatagaatcgttcactctgcaggctgggcgcggtggctcatgcctgtaatcccagcactttaggaggccaaggtgggcagatcacgaggtcagaagttcgagaccaccctggccaacatggtgaaaccccgtctctactcaaaatacaaaaattagctgggtatagcagtgggggcctgtaatcccagctactcaggaggctggggcaggagaatcacttgaacccaggaggtggagcttgcagtgagctgagattgcaccactgcactccagcctggacgacagggcgagactccgtctcaaaaaaaaaacaaaaaaaaaaaaacaggtttgttcaatccgctggaaagggggctgaagccagggagccaagtggtctggctccatgggtcccacccccacagagctcagcaagctaagatccactggcttgaaattctcgctgccagcacagcagtctgaggtcgacctgggatgcttgagcttggtggtgggaggggttgtccgccattgctgaggcttgagtaggtggttttaccctcacagtgtaaacaaagctgcagggaagttcaaactgggtggagcccaccacagctcagcaaggctgctgtggccagactgcctctctagattcctcttctctgggcagggcatctctgaaaaaaaggcagcagccccagtcagggacttacagataaaacccctggccagcacggtggctcacgcctgtaatcccagcactttgggaggccgagacgagtggatcatttgaggtcaggagtttgagactagcctgactaacatggtgaaacaccatctctactaaaatacaaaaaaaatgagccaggcgtggtggcaggggcctgtaatcccagctactcgggaggctgaggcaggagaattgcttgtacccaggaggtggaggttgcagtgagccgagattgtgccactgcactctagcctgggtgatagagtgagactctatctcaaaaaaaaaaaaaaatctccctgggacagagcacctgggggaaggggtggcttggaaacagcttcagcagacttaaacgtccctgcctgatggctccgaagagaactcccaggacaacattcgagctctgataagggtcagactgcctcctcaagtgggtccctgacccctatgtatcctgactgggagacacctcccataggggccaacagacacctcatacagaagagctctcgctggcatctggtgggtgcctctctgggacaaagcttctagaggaaggaacaggcagcaatctttgctgttctgcggcctccagtggtgatacccaggcaaacagggtctggagtggacctccagcaaactccagaagacctgcagcagaggggcctgactgttagaaggaaaactaacaaatacaaaggaatagcatcaacatcaacaaaaaggacgtccactcagagaccccatctgaaggtcaccaacatcagagaccaaaggtagataaatccatgaagatggggagaaaccagcacaaaaaggctgaaaattccaaaaaccagaatgcctcttctcctccaaaggatcacaattccttgccagcaagggaacaaaactggaaacagagaatgagtttgaagaattgacagaagtagacttcagaaggtgggtaataacaaactcctccgagctaaaggagcatgttctaacccaatgcaaggaagctaagaaccttgaaaaaaggttagatgaattgctgactagaataaccgtttagagaagaacataaatgacctgatggagctgaaaaacacagcacgagaacttcgtgaagcatacacaagtatcaatagccgaattatcaagcagaagaaaggataacagagattgaagatcagcttaatgaaataaagcgagaagacaagattagagaaaaaagaatgaaaagaaacaaagcctccaagaaatatgggactatgtgaaaagaccaaatctacatttggttggtgtacctgaaagtgacagggagaatggaaccaagttggaaaacactcttcaggatattatctaggagaacttccccaacctagcaagacaggccaacaatcaaattcaggaaatacagagaacaccacaaaatcaatgtgcaaaaatcacaagcattcctatacaccaataacagacagagccaaatcatgagtgaactcccattcacaattgctacaaagagaataaaatacctaggaatacaacttacaatggatatgaagacctcttcaaggagaactacaaaccactgctcaaggaaataagaggtcacaaataaatggaaaaacaatccatgcttatgtataggaagaatcaatatcgtgaaaatggccatactgcccaaagtaatttatagattcaatgctattcccatcaagctaccattgacttccttcacagaactggaaaaaactactttaaatttaatatggaacaaaaaagagcccccgtatccaagacaatcctaagcaaaaagaacaaagctggaggcatcacgctacctgacttcaaactatagtacaaggctacagtatacaaaacagcatgatataccaaaacagatatatagaccaatggaacagaacaaagccctcagaagtaacaccacacatctacaaccatctgatctttgacaaatctgacaaaaacaagcaatggggaaaggattccctgtttaataaatggtgttggaaaaactagctagctatatgcagaaaactgaaactggaccccttccttacaccttatacaaaaattaactccagatggattaaagacttaaacataagacctaaaaccataaaaaccctagaagaaaacctaggcaataccattcaggacataggcatgggcaaagatttcatgactaaaacaccaaaagcaatggcaacaaaagccaaaattggcaaatgggacctaattaaactaaagagcttctgcacagcaaaagaaactatcatcagagtgaacaggcaacctacagaatgggagaaaatttttgcaatctatccacctgacaaagggctaatatccagaatctacaaagaacttaaacaaatttacaagaaaaaaaacaactccatcaaaaagtgagcaaaggatatgaacagacacttctcaaaagaagacatttatgtggccaaaaaacatatgaaaaacagctcatcatcactggtcattagagaaatgcaaatcgaaaccacaatgagatactatctcatgccagttagaatgatgatcattaaaaagtcaggaaacaacagatgctggagaggatgtggagaaataggaatgcttttacactgttggtgggagagtaaattagttcaaacattgtggaagacagtgtggtgattcctcaaggatctagaaccagaaataccatttgacccagcaatcccattactgggtataaggattataaatcattctactataaagaatacatgcagaggtatgtttactgtggcactattcacaacagcaaagacttagaaccaacccaaatgcccatcagtgatagactggataaagaaaatgtggcacatatataccatggaatactatgcagccataaaaaaggatgagttcatgtcctttgcagggacatggatgaggctgaaaaccatcattctcagcaaactaacacaaaaacagaaaaccaaacactgcatgttatcactcataagtgggaggtgaacaatgagaacacatggacacagggaggggaatatcacataccagggcctgtcagggggtagggggctaggggagggatagcattaggagaaatacctaatgtagatgacgggttgatgggtacagcaaaccaccatgacaagtgtatacctgcgtaacaaacctgcacattctgcacatgtaccccaaacttaaagtataataaaaattaaaaaaagaaatctaaacacagaaaaggtacagtaaaaatatggtatagtcgattttaaaaggtacacctgtagagtgtgtacttcatgcatggagcttgaaggacttggtgttgctctgagtgggtcagtgagtgagtggtgagcaaatgtgatggcctacgacattactgtacactactgtagaatttatcaatactgttcacttaggctgcactaagtttatgcaaaaatatttttctttcttcagtaataaattaaccttagcttactgtaaaaaaaaaaaaagtgaaaagttaatatttatgtgttctgtgttcaggaaaccaggaggaatggatttggctgaaactggaatacatggatagataaggctagagagataggcaggagccaagccaacaatactaggctcccatcaattgctggggcaggcaagagcaggcatcatcctgagtgtttggagcttcttttcatgttccctaagttggggggtgttggggggatgatacagggggaaattctgattaagacttaacatctattcctttgccttctcttcaagaagtcatacttgatgtccatccctcctggacagggtccgttctgtttgctgctaagctcctttcttatctctcccacctactgaacacgtactgtgttctgggagttttgaatgcatcatcttgtttatcctcatgagatggtctaataatgaagaaagcatgttttggcatccaactcacctgggtatgagtcccagctctgccttttactagctggatgtctttgagcagctcagttccctgttctgtgcttctgtgtcctcatctgtaaaatgggaacgacggctatttcttcagactgccctccctccctccttttctgtctccctccctccctcccttcctccctccctctttcccccttcttcttttcttttctttctctctttctttcttttcttctttccttctttcttttttctttctccttctttccttccttccctcctctctctctctctttatttctgtctgcctgtctttcaacagggtcttgctatattacccaggctggtctcaaactcctggactcaagcaatcctcccagcttggccccccaaagtgctaggattacaggcctgagcacctggcctggactttcttcagacttttcacagggtactagtgagaaaaaaatacatggactctgcttacttaatactgtgcctggcacattgtaagctcttcgcacatgttattgttattattcctcatcctaagggggaagtgcctttgaagggtccacactcctttgttacccaaattgggccaggttgcttaaactgccgttcttcagtagctaacaacaggggtgggagagcctggtcctctgaagtccagctgggcacacggccagtccctggcctgtccctgctcctgctgccctggcaaggcctccctcacccactggggctgcaccagcactggccccagctcagcttcctgtctcccttatcttcctccagcatgtgctctctggagtaggaaacaccaccgcttgcttccttcatttccctttgctcaacgggaccctcattctttaggtctcagtcaaatcccagctgctggcctggtgcccactctgtgattttctacacctcagccacccaggccagatgcagtgtaggccatggctccaacagcagcatttctcttttcttccccacccccatccctgggtttagaatgagaaaaggctcaagttgcccccctcccaacttccctacccgcaacactctttttattttctctgttcccagctccatacttccatgcttttttttttttttttttttttttttgagatggagtcttgttctgttgcccaggctggagtgcagtggcaggatctcggcttactgcaacctccacctcccgggttcaagtaagtctcccacctcaacctcctgagtagctgggattacaggcacgccaccatgcccagctaatttttgtatttttagtagagacggggttttaccatgttgcccaggctggtctcaaactcctgacctcaggtgatccatccaccttggcctcccagagtgctgggattacaggcatgcccagtcccatactttctgagttcaaatcctcgctctgcacttccaagctgtgtgaccttgggcaagttacttaactatttttctgggctttgattttttttttttttttttgtacagaggagcagaggaggattcatcaggttgcccaggttggtccaaactcctgggctcaagggatccttctgcctgggcctcccaaaatgctgggattacaggcatgagccaccatgcccagtttttttggttgttgtttgttttgttttgttttgtttgagacagggtctctttctgtcacccaggctggggtgcagaggcacagacatagctcactgcagccttgaccttttgacatcctgggctcaagccatactcctgcctcagcctcccaagtagatgggaccacaggtgtgtactaccatgcctggctaatttaaaaaaaatttttttgtagagatggagtctcatatgttgccatgctggtcactaatttacaggcatgagccactacacccaggcagctttattttatttatttttttgtctgtagcatggaaacaatgagcatggtctgccccagagaaagtgattaaaggcctagcacatagtatgaatttaaagaatgttttataacatatatattaaacattcaagcatgttggaggtatgtgttaaaaaaatgtattgatggaaagtgatcaaaataatttttgagtcactgtgtgggagttaaattcacaaactttggcaccagagagagagagaaactttcaaattatagcttttgctgtgtgaccttaggtaagtcacttaacctctctgagcctcagtttcttagtaaaatggtgatgctagtgaaacccatttcacagggctagcataagaataaagtaagattatttaagtaaagagccgaacactgtttctggcctacaataagtgttacctataataatgctatcattgtctcactgttcaattttcagggctctagtatatgagaggggtgcttgggaaatagctgttgctgctgctatctgtccatgatggatcttaacctgattagaaaggcctccatgtggctgggcgtgggggctcgtgcctgtaatcccagcactttgggaggccaaggcagatggatcacttgaggtcaggaattcgagaccagcctggccaacatgatgaaaccctatctctactaaaaatgcaaaaattagccaggcatggtggcacctgcctgtaatcccagctacttgggaggctgaggcaggagaattgcttgaatccaggaggtggaggttgcagtgagcagagatcataccattgcactccagtctgggcaacagagcgagactccatctcaaaaaaaaaaaaaaaaaaagaaagaaagaaaaggaaagaaagcccttgatgtaatgagctctgtgtaagataatgtggatgaaagtggacccagaccctacccgcttagatggaaggctcacagcattcaattccaaattggttcaatcgtacactcttttgccctctcttatccatcccaaagtacccttcaagccttcaagggagaaaaaaggcaaagcaaaaatatgcacaacctcactaagaaccagaaaaatgcaaactaaaaccaaagagaaatgccattttacacccaaccatctgataatgccaagggctggcaaggatgtgaagcgagggaattctcatacactgctgggaacgtaaattggcacaacctttctgtaaaacagtttggcaatatctagtaaaactgaagatgcatatactttattactcagaaattccactgtcaagtttgcacctacaaaaactcccacatatgcacaaggactcgagtatgagaatgttcataccagcactgtttgtaatagcaaaaaactggaaaaaacttaagtgttcagcaacaagagaatggatacataaataatgatctattcccaaaattgatttttttttttgagacagggtcttgctctgttgcccaggctagagtgcagtggcatgatcatggctcactgcagtctcaacctcctgggctcaagcaatcctcctacctcagcctcctgagtagctgagaccacaggcacaacccatcacacccagctaattttattttttttgtagagatgggggtctcactatgttgcccaggctggtcttgaactcctgggctcaaatgatccacccacctcggcctcccaaagtgctgggataatacctccccagccggaatattttaaagcagtgaaaatgaatggtctacacatagccacatgaatgaatcttattaatacattaagtgaaaaaagcaaaaggtacagaggaatacatacattttaataccatttatataaagctcaaaatatgtgaaataccactatctattgtttagggatatatacataagtagtgtaagtatacagaaatataaggaaatgaaaaatatcaaatcttcattttcatctgaagtggttacttcaggggctgtggcagggagagagagatgcagctgaggaagagtccatagggggcttcaactatattagcaatattgtatttcttatgcttggtggtggggataggtatgtttgaaatgtaatcctttaagcatgaaataactcttcaaaaatgaaatatttcaggctgtgcacagtggctcaggcttgtaatcccagcatgttgggaggctgaagtgggcggatcacctgaggtcaggagtttgagaccaacctggccaacatggtgaaatcccatctctactaaaaatacaaaaattagccaggtgtggtggcaggtgactgtaatcccagctacttgggaggctgaggcaggagaatcgcttgaatctgggaggtggaggttgcagtgagccgagatcacgccactgcattacagcaagactccatctcaaaaaaaagaaaaaaaaaaagaaaaaagaaatgtttcataatttttaataaaaggcaagacaatataaattggtagttatttaagtcattctacttttcctgaggcccagtgcaggaaaacaaagttcctatccttgttccaactagaccattttgataagctgcaaaaagaaaagactttgatgctatttcttagccagtttgcaacagctgagaggtgagcatggaagctcttgcatatattcagttcagagaatgggtgcttagtttatgtccagagtttgtcccagatttcactatgacgtcagctctccggggagaagtatataaaataaaaagttaaaatccctctcagtcctttacccaatcctattccccagaggtaatctctattgacagtacccctccagatattttccctatgtatatacaaatacacagatacacactgaaagttaattttggccaggtgcagtggctcctgcctataccagaggattgcttgagtgcaggagttcaagaccagcctgggcaacatagcgagaccacatctctagtaaaaataaaaaaaaatagctaggcgtggtggcacagtggcacgtacctttagtctcagctactcgggtggttgaggtgggagaatcacttgagcccgggaggtcaagcctacaattagctgtgattgcttcactgcactatagcctgggcaacagagctagaccctgtctcaaaaaaataataataaattttatatatatatatgaggatgaaattacatatgtattatttgaacagaagtgaaatcttttctttttttttttcagacagaatcttgccgcatgacccaggctagaatgcagtggtgtgatctcggccctctgcaacctccacctcccaggttcaagcgattctcatgcctcggtctcccaagtagctgggattacaggcatgcaccaccatgcccagctaatttttgtatttttcgtagagacgttcgccatattggccaggctggtctcaaactcctggcctcaagtgatctgcccacctcggcctcccaaagtgccagcagcatgctcggaggagtgactttaaagcttttctacttgcttcctagagtaagggacgcattttacactgctatccaaaactcatcatagaaacatacacacacaaaaccaaagcacacatatacaactgagcaaatatttcatgacataacactttctcttactaagggtgacgcgctgaaattttgtattctgtcctatttcattttttaaaaatggtaaccatgacctgctaaattgatttcattgtccactaataaattatgacctcagtttcaaaaagattgctttaggtaaccaatcatcttctgagatttatacagattgctcataattctctcctattttttaaaaacatgctgcagtgaactgctttacactcattttatgactacttctgagaccaagatcccggattatgtaattgttatttacttaaaattctggtaaaatgtagccattatactggaaaactaaattttaatcttggatctgtcaccaccatgatatataaactttgggcaagtccctgcacctctctggacctcaatctccccatcagcaacctgctgatcctactcccaggagtgtgctctaagttgaaagtagatgccccaccccctgagtcagcgccggcaggacttctcaccaagcccttctcccccttttccgctccctgttcctggttcctaggaagcagcccaaggagaagggaaaaggcaggtctgggcaggagggagcaatgaagggcggggcagagggagggcaggagggaggccggccccctagtaggaaatgagacacagtagaaataacactttataagcctcttcctcctcccatctcctggcctccttccatcctcctctgcccagactccgcccctcccagacggtcctcacttctcttttccctagactgcagccagcggagcccgcagccggcccgagccaggaacccaggtccggagcctcaacttcaggatgttgacaacattgctgccgatactgctgctgtctggctgggccttttgtagccaagacgcctcagatggtgagtcgggggcacatctcctgcctcaggatggttctggagaatctcagtctatctgggcacatggcaagaccacaggagagcttatctcacagcatctgtgtctgcagctggctagatctctctacagggcaggcagagtcttggggactggttcgtgtcccaaagccaaggtgagttagtacatttaagcccctgaaaagggggagatgaaagaggctaggggaaacaggatgactggaaacatgagaaagaaaccagcagagagggtaggagaatcagccccagggagaggggagaaaggggaactgagggtgatggtagataggggtacatctaggggagacgggaagaggctcagaagagaagagaaatggagggaatgggaagaccctgggaaaactgatggaagaagtgggggaagagtggggcagagagaggttaggggaggctagggaaaatggaaggagactggtcgcagctggtggaactggggagaaagagatgctgtgcctaatagaacttatgggcgatcaggctactgaagtggccctgtttaagcagaaaagggagttattaccctccattataattgcacaggggcctcctttcccctctctcacaatccccgtaacttcagtctccccctcagagaggcagcaaataataaccagtattcaatgagtgctcactatggttaatacatgtattgacccatttaacttgcacaaacccctaaaggtgggtaatattattactatctccattttatgaggaggaaactgggtcacagagtagttaaggaccatgtctagggttatccataaatatacttattcacatctgcagatacaaagcacaacttctcaaatgcaaacacagacaggacccactcacacacacagatttacaaccccggactcatccaaatgtgctctgggcatcaactctgtgccagcctcttttctgggtgtaggaagcagagattaccaagcatggttccatagcctagaggagtccagtgtggcctgtgtgtgtttggagacagccaggtagtatcccgtgagatacacactaatatatggtggtctgggatcactgaaacagacacactgtgtctcgtggggcatcagaaaaaaatttccaagaagagggcaactgagctgggtctttttttctttgcttttctttcttttttcttttttttttttttttttttttttgagatggagtcttgtgctgtcacccaggctggaatgcagtggcacaatttcagctaactgtaacctccaactcccaggttcaggcgattctcctgcctcagcctcctgagtagctgggactacaggcatgtaccaccacgcctggctaatatttgtatttttagtacagatggggtttcgccatgttggccaggctggtcttgaatccctgacctcaagtgatccgcccgcctcggcctcccaaagtactgggattacaggcatgagccaccgcgcccagtctctgagctgggtcttaaatcatgaataaacttcgccaggcagaaaaagggaggcagagcaatcctgacatgctattcatgtgtcagccaaaggcagcatgaggaatcccaactagtttgatatataagcagcgggaagcggccagaaaaggcagcaggggccaggtctctagcagccttgaatgccaggctaaagactctggacttgatcctgtggggaggcagtgtagcagaatggctgagtgctggacttgactgcctacgtgcaaaccttggctctgctacactatctctgtctcagtttcccatgtagactggggttaataatagtagctattgcattaagccactggggaaaggcacaaagataataatgtatgtaaagcccattgcccaggttataataagcactgaatcgacattggctatgattatttttgattaatgaaggggagggggttatggcactggaagattttaagtaggaaaaggacatgatctcatccctgggtcaggtggaggtcggaatagagaacggggagatgaagtagaaagttactaccccagtctagatgagacggatgaatcctgaatcagggcagtggaagaggagatggagaacaggcgatggaattggaattttattcaggtcaggatttgttaaccatttgttccgttggttaacaggaaacggggggagggagagccgagggtgaaaaaggaggcagaaaggagtgtctcttccactgcaggcctcagtttcctcatctgtaaaacggagataataatccctgtcctgtcctcctggcagagttactgtcagcgtcaaacgggagaagcggtgggagggcacattatagtttatgaagggtcgagaaggcgggcggccagcctcgaggtagggggttattatcttccgctgcccgccgccccctcccacgccggcccaggctgaagctgactctgcccgcaggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctgtgagtaggcgcgcagcgggggcggggtctgggcggggctagtgggggcggggcctggcgggtgggggcggggcctggcggatggaggcgggctgggacttgcagggacccggcagccactggagctcggtggcgcctgggcctttgaagattgctgggtgggggctggagagaggcagttgtccccgctaagaaagccccgactcgggcggtcgtcctgctggcataacctcttgggatagaccctgttggaaggccctgacaccgtgacgtcgaaggtccccagaaaactcctcacccctcgcctcacagtcctccaactccttttcttcatagatctccgtccttcccttcccacagcccccagcacttcaccccccaccctccagccacttctcatacaagctgatgacttcgctcttagctccactcatgacccgaactcttcccccaaagaccccaagttcttctctcaaagccccactccttccccgtcacaaccctaactccttcttctcaaagaccccaatttcttttctcaaagcaccaagcaccactccgtcccccttcccccaccatcatggcctttaactcctttctctcctagtcccccaccccaccccccttttttttttttttttttttttttgagacggagtcttgctctgtcgtccaggctggagtgcagtggcgcgatctcggctcactgcaacttccgcctcccgggttcaagcgattctcctgcctcagcctcccaagcagctgggactacaggcacccgccaccacgcccggctaattttttgtatttttagtagagacggggtttcgccatgttggccaggctggtctcgaactcctgacctcaggcgatccacaagcctggcctcccaaagtgctgggattacaggcgtgagctgccgcccctgccccagcctcaccccctgttttttttttctattacagttgaacaaggcctgacaattcccttttttcatcacagtccctggccccttctttcttagcctctaacaggctaaccccaaacccctcctcacagccccaggcccttctccccatagttccctgacctagactcccctctcctcacagcactgactcttgccttctcatgttcttttccccttggtgggcctcgccccacacctggcaccctctctgcacagtcccctgaccctgactgtctatccacagttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaaggtatgatgggacggggcccaggcctgcaagctggggagagggcgggttccagacaaatggatggacctgaaggatggatgcctagagcaacaagaggcccacagctgggggtttgggacagaacacacgcagcttcagtcagttggtaaacgggtccctttcctctggggcagaaacgctttggggtttgactcaaatcatggactccttgggggcctattcttcgggctaactctttgcatgttctgcagggagccaaacaagccgctcctacacttcgctggtcctgggcgtcctggtgggcagtttcatcattgctggtgtggctgtaggcatcttcctgtgcacaggtggacggcgatgttaattactctccagccccctcagaaggggctggattgatggaggctggcaagggaaagtttcagctcactgtgaagccagactccccaactgaaacaccagaaggtttggagtgacagctcctttcttctcccacatctgcccactgaagatttgagggaggggagatggagaggagaggtggacaaagtacttggtttgctaagaacctaagaacgtgtatgctttgctgaattagtctgataagtgaatgtttatctatctttgtggaaaacagataatggagttggggcaggaagcctatggcccatcctccaaagacagacagaatcacctgaggcgttcaaaagatataaccaaataaacaagtcatccacaatcaaaatacaacattcaatacttccaggtgtgtcagacttgggatgggacgctgatataatagggtagaaagaagtaacacgaagaagtggtggaaatgtaaaatccaagtcatatggcagtgatcaattattaatcaattaataatattaataaatttcttatatttaaggcattgttatctcctccactttgcaaaatttctggaaaagtaacctatacccatttcttctgcttccttatttctcactcattctttttttttttttttttttttttgagacagagtcttgctctgttgcctaggctggagtgcaatggtgtgatctcagctcactgcaacctctgcctcccggttcaagcaattctcctgcctcagcctcccaagcagctgggattacagatgcatgccaccacacccagctaatttttgtatttttagtagagatggggtttcaccacgttggccatcctgacctcgtgatccgcctacctcggcctccccaagtgctgggattagacgtgagccactgcgcctggtcttctcactcattcttagacccagtgcaatctgacttctctataaactactctgagatcaccagtaacctctaattgtcaaaccatcaccctacatggtatctgcaaatttgcggactagaactctctttttgccttaacttctgagataccatacttcaatttttaaaactgttctgtctactttttttcaatccctttgactatgtcatcttacacgattcaccctggaaatgctggcttccttagaattccattttttggttccttttgttcctgtttgaactataccctttctaggtgacctactgaccttcatggctgcaaatactatctacctgtggtttccatggagaagcaatataattttatctttaagagcatgtgttttgtcggccaggcgcggtggctcacgcctgtaatcccagcactttgggaggccgaggcgagaggatcacttgaggtcaggagttcaagacaagcctggccaacacagtgaaaccctatctctactaaaaatacaaaaattagctaagtttggtggcacgcgcctgtaatcccagctacttgggaggctgaggcaggagaatcacttgaacccgggaggcagagtttgcagtgagctgagatcacaccactgcactccagcctgggcaacagagtgagattctttttttttttaattctaaaaaaaaaaaaaaaaaaaaaagagtatgtgttttgtcatcagacttaagttttacttctttgaactagaaatttaacttcttcaagtctcagttttttttttttttttttttttttttgagacgaagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccattttagccgggatggtctcgatctcctgacctcgtgatccgcccacctcggcctcccaaagtgctgggattacaggcgtgagccaccgcgcccggcctaagtctcagttttttttgttcccaaatggtattaataaaatataccaaagggtctaagaaaaacaatacccaattcataaaggcatgaagagtattaaataaaagtatatatgtaaaataatatgccaagcgcaagctgggcacggtggctcatgcctgtaatcccagcactttgggaggccgaggcgggcggatcacaaggtcaggagatcgagaccatcctgactaacacagtgaaaccctgtctctactaaacaaaaacaaaaaattagccgggcatggttgcgggcgcctgtagtcccagctcctcgggaggctgaggcaggagaatggcatgaatccgggaggcagagcttgcagtgagccgagatcacgccactgcactccagccttggcgacagagtgagactccatctcaaaaaaaaaaaaaaaaaaaaaaatgccaaacgcaatgactggctcacacctgtaatcccaacactttgggaggcagaggcaggaggattgcttgagctcaggggtttgagaccagcctagacaacatagtgagaccctgtctctacaaaaaaaaatagaaaaaattagctgggcatggtggtgtgggcctgtagttccagttactcaagaggctgaggtaagaggattgcttgagcccagaaggttgaggctgcactgagccatgatcgtgccaccacactgcagcctggcaacagaccaagaaaaaaaaaaaaagatagtgtatgtatagtcagtaaatacagcagtggcttctgatctccagacctctcatttgcattgattctttaaaatcatctctaccttaatgttctgtagacatttcaaaatcaacatgttcaaaatcaaatttattatctatctccccaaatctgctctctctacttctgatgtttactgttcattaatggataacagaataaccatcaaatcatgtaagtggagagaactcagtgttaacctttatttactccctcttatttatccccatctaccaactacagtatctataaaacacattcactcctttctaccccattgcttttgttcaagatatcataattcctctctttctttgtggtaaacatgaaggtgtaccatccagttctacctccaaagaaagacttcctgttggccgggcatgatggttcacgcttgtaatcgcagcactttgggaggccgaggtggggggatcacctgaggtcaggagttggagaccagcctggccaacatggcgaaaccctgtctctactaaaaatacaaaaattagccgggcgcggtgatgcacgcttgtaatcccagctactagcaggggctgaggcaggagaatctcttgaacccaagaggcagaggttgcaatgagctgagatctcgccactgcactccagcctgggcaacaagagcaaaattccatctcaaataaataaataaatacataaataagaaaaaaaagacttgccgttcagctatagggggaatagccagcagatagcttccgcttgcttcagttctttcaatgtctgcctcagctgtagaggacagtcctgcacaagatcatgcccatcccagggctgccctcactcggtgcctaagcaaggcaggggtataaaagttcggtcattttggccaactgcaggacaactctgagaataggttggattgacaagggctagccagggctggaaatattcactccagagctccctgccagggaggctgggtctttgtcagatctgcattgccgtttgacttctctcttagctcagccctacttcttccccctggtaagcatcttgcacctcaaactctgtctcagcctctgcttccagataacccaacttgtgtgtgtgtgtctctctctctttcaaaattgagaaattttctcaatcttgtctggaccatggcagcagcctcctcctaagaaattgcctctaatttctccatattttaattcatcttctacatggcagtaagaaacacagatctaattgtgtcattattccgttttttgttgttgtttgttttttgttttttgttttgttttgttttgttttgagacagagtctctctctgtcacccaggctggagtgcagtagtgtgaacttagctcactgcaacctctgcctcacaggttcaagcaattctcctgcctcaacctcccgagtagctgggattacaggcatgtgccaccacgcccggctaattttttgtatttttagtagagtcggggtttcaccatgttggtcaggctggtcttgagctcctgacctcaagtgatctacccgccttggcctcacaaagtgctgggattacaggcgtgagccaccacgcctggactgttttttaaatttctcattgagttaaattcagaatcctcaaaatgacattcaaggccttgcacaatgtggccccaacctaattttctaatttaattttaatttaattttattttattttattttgagatggagtctcactctgtcacccaggctggagtaaagtggtgcgatctctgctcactgcaacctccacctcctgggttcaagctattctcctacctcagcctcccaagtagctgggattgcaggcatgtgccaccacgcccggctaatttttgtatttttagtagtgacggggtttcaccatgttggtcaggctggtcttgaactcctgacctcatgatctgctctccttggcctcccaaagtgctgggattgccggcgtgagccactgtgcccggcccctcaaattttattttctaccatttctctttagccactgtgccttagattatttattttaaaagcatatttttaaatgacggaagtggtacaacaacagcaataacagagaagtttacaaagaaatttcataaaggaaaaacggaacgcctcctgctttctcattctccccaaatccttactccagaggtatgctaagattattagttgcaagcaacagaaaccaattctgccaacttaaggggaaaataagtatattggaaggttattaagtaatcctcagagttgatgggaaagccagataatcaagctcagaaagtagaaccagggaccacagccaaagtcacaccacaggaatggtattaaggatgccacagctggaagcactacctccatcaccaatgctgctgccatattaaaggaattctcctctgaccctgtgtctttacatcatttgttcaagagtcaatatcctgagtggaagcagccaaatgaccaagccttgatcatgttgcttttgccttagctgcaagtgcaggggggaaaaggaaaactttagatacctttgacttctcttgtgggaggtgagaacctgtctcccattaagactcacacagaggaagagatttcagatgctgggcaaccaaaacaggtacaggtgattttaaagaattgatgcaaatgagaagcctggagatcagtagccactgctgtatttactaactctacatatattatcttttttttgagacagactcttggtctgttgcccaggctggaattggtggcacgatcatggctcactgcagcttcaacctcctgggctcaaaaaacagaacaaaagaaaaataaaatagaaaagcaaaaacaacaaaaacccataaatgttcactatatctcacatcattaatttatttactcgtttaataaatgtttgtcagaaacttccatatagaaggctttatgttatgtactttggaagacacaaaacgattaggatatgatccttctcaaggagcccagtcttttcttgggaagataaaacatacaaaagagaacaacacaaggcaagatgcattgtataactagaagaaacacacaaataaaaatgtgatgttatgtggccgggcatggtggctcacgcctgtaatcccagcactttgggaggctgaggtgggcagttcacctgaggtcaggtgttcgagaccagcctggccaacatggtgaaaccgtctctactaaatatacaaaaattagccaggcatggtggcacgtgcctgtagttccagctactcaggaggctaaggaaggagagtagcttgcacccaggaggcagatgttgcagtgagttgagatcgtgccactgcactccagcctgggcgacagagcgagactccgtctcaaaaaaaaaaaaaaaaaaaaaaaaaaggaaagaaagaaagaaaaatgttatgctctgatttactcttgtagctatcatttacatattgctatatagtttttggaattctgtaacttgcgtttatcatttaatactctctttggtcttgtaagatagatataatcattttagattaggagacatgtttagggagaataagaaagttaataactgatatggtttggatgttttgtccctccaaatctcatgttggaacgtgacctccattgttagagatgggcataatgggaggtgtttgggtcatgggggcagatccctcatgaatggcttaacaccatcctttagtgttgagtgagttcttgttcagttagattacacatgagatctcgttgtttaaaaggatctgagacctcccctcctctttcttgcttccttctgtctcatcttatatgcctgctccccctttgccttccaacatgattgaaagcttcctgaggcctcaccagaagaagatgctggtgccatgcttcctgtacatcctgcagaagtgtgagtcaaaaataaacctcttttcttttataaattagccacttgcaggtattccagtatagcagcacaagaattgactaatatagtatcagagctaggattcaaacccgtgcctttgtgttctaggatttatgctttctctcctctactaaaactgcaggaatcagaggaatctaggggagaaacatggtatttgtgaattggtgagatatgaccatgcccagataggaaagatagacagaacagattcaataatgaaaataggaaaaagcagagtaaattttagacatttcttaaagaagatacaccagtggccaataagcacatgaaaagatgcccaacatcgttatagtcattatggaaatgcaaatcaaaaccatgagataccacttcataccatcaagaatggctataggaggatggatagaatcaatattgtgaaaatgaccatactgccaaaagcaatctacaaattcacgcagtccccatcaaaataccaccatcattcttcacagagttagaaaaaacaattctaaaattcatatggaatcaaaaaagagcccacatggccaaagcaagagtaagcaaaaagaacaaatctggaggcatcacactacctgatttcaaattatactataaggccatagtcaccaaaacagcatgatactggtataaaaataggcacatagaccaatggaacagaatagagaacccagaaataaacccaaatacttatagccaactgatctttgacaaagcaaacaaaaacataaaagtggggaaaggacacccttttcaacaaatggtgctgggataattggttagccacaggtagaagaacgaaactggatcctcatcttttaccttatacaaaaatcaactcaagatggattgaggagctgggcgtggtggctcacgcctgtaatcctagcactttgggaggccgaggcgggcagatcacgaggtcaggagattgagaccatcctggctaacacggtgaaacccatctctactaaaaatacaaaaaattagctgggcgtggtggcgggcgcctgtagtcccagccactcagaaggctgaggcaggagaatggcgtgaacccaggaggtggagcttgcagtgagctgagatgacgccactgcactccagcctgggtgacagagcgagactgtgagactctgtcacaaaaaagaaaaaaacacaagatggattaaggacctaaacccaagacctgaaactgtaaaatttctagaagataacattggaaaaacccttctagacattggcttagccaaagatttcaagacaaaaaaaccaaaagcagttgcaatataaataaaggtaaatagctgggacctaattaaaccaaagagcttttgcacggcaaaaggaacagtcagcagagtaaacagacaactcacagagtgggagaaaatcttcacaatctatacatctgacaaaggactaatatccagaatctacaatgaactcaaacgaatcagtaagacaaaaaaaaaaaaaaaaaaaatcaatcccaacaaaaagtgggctaaggagatgaatagacaattctcaaaagaagatatacaaatagccaacaaacatgaaaaaatgctcaacattactaatgatcaggaaaatgcaaatcaaaaccacaaagcgataccaccgtactcccataagaatggccataatcaaataataaaataatagtagacgttgacgtggatgcagcaatcagggaacacttctacactgctggtgggaatgtaaactagtacagctgctatggaaaacagcgtggagattccttaaaaaactaaaagtagagctaccatttgatccagcaatcccactactgggtatctaccccgaggaaaagaagtcattattcaaaaaagatacttgcacacgcaagtttatagcagcacaattcaccattgcaaaatcgtggaacaaacccaaatgcccatcaatcaatgaatggataaagaaactctggtatatatatatgatggagtactactcagccataaaaggaatgaattaacagcatttgcaatgacctggaggagattagagactattattctaagtgaagtaactcaggaatggaaaaccaaacatcatatgttctcactgatatgtgggagctaagcgatgaggatgcaaaggtataagaatgatacaatggactttggggacttggggcaaagagtgggaggggggtgagggataaaagactacaaatatggtgcattgtgtactgcttgggtgacgggtgccacaaatctccaccaaacaacttactcatgtaaccaaatgccacctgtacctcgataacttatggaaaaataaaattttaaaaagaatggctataggaaaaaagacagacaataacaagtgttggcaagaatgtgaagaaattggaaccctcatacattgctggtggcaatggtatagcactttggaaaacaatttgacagttcttcaaaaagttaaacatagagttattgtgtggcccagcaagtccgctcctagtatatgcccaagaaaattgaaacatacatccatgcaaatacttgtacatgaatgttcacagaagcattattcctaatagccaaaaatggtaataatccaaatgtctgttaattgatggagaaacaaaatgtagtattttaatacaatggaatattatctagccatgaaaatgaggtactgacacatgttacaacacggatgagccttaaaaacatgataagtagtccgggagcagtggctctcgcctgcagtcacaacactttgggaggccaaggcgggtggatcatgagatcgggagttcaagaccagcctgaccaacatggagaaaccccgcctcttctaaaaatagaaaattagccgggcatggtagcacatgcctgtaatcccagctactcgggaggctgaggcgggagaatcacttaagcccaggaggctgaggttgcggtgagccaagatcgcgccattgcactccagcctgggcaacaagagtgaaactccatctcaaaaaaaaaaaaaaaaaaaatgataagtaaaagaagccagtcacaaagaaccaggtattatatgattcaacacacgtgaaacatccagaataggcaatctgaccaggcacagtggctcatgcctgtaatcccagcaatttgggaggccaaggcaggtggatcacaaggtcaggagatcgagaccatccttgctaacatggtgaaaccctgtctctactaaaaaaaaaagtacaaaaaagagctgggcatggtggcacgtgcctataatcccagttactcgagaggctaaggcaggagaatggcgtgaacctgggaggcggaggttgcagtgagtggagattgcgccactgcactccagcctgggcaacaaagcaagactctgtctcaaaaaaaaaaaagaaaaaaaaatagcaatagctgtttaagtcagtggcctgcaaaacatgttaacaattaggtcaattccttctttgcgcttcctcaatccatagtttgatctatcttcctccaaatctgctctgtcactcaggctggagtgcagtggtgtgatcccagttcactgcagtctccatctcgcaggctcaaacgatcctcccacctcagcttcctgagtagctgggactacaggcatgcacctccaagcctgcctaaatttgttttgtttgtttgtttgtttgttttgtagagtcagggtttcaccatgttgcccaggctcgaattcctgaactgaagtgatccacctacctgggcctgccaaagtgctgggattacaggcatgagccaccacacctggcctgaacacgcttatactaatggtgaaataatgttgggtagctgtaagtggcttgcccaaagttccacagtgatgtggtacaagaactggcactagagcttgggacttctgacttctgatcctgagctattgctgctacatcattccatgagaggcattaggaatcataggttaaagaggtaaggtactacttggagggattctctgaaaatttttgcccatgtccaaaagcaggagaggtaagtaatcagggaaacagtgggatgaataactctgaccgtttagggagaagatatgatcctcatttccaggagtttctacacagggtgaagagtgaatggaaggttcatctgcttatgcttacgtatgtgaatacatgttcatagctacatgaccttagataagtcagtgcccctctctgagagggagtttgtaatctctgagatatctaaggtatctcccagctctgataactaggattctacattcctaagtccagatggctgacaggacaattgtaaaggtcctagaagttccattcctctttttgggaatgatcttagaatgtttggcttgggtcagttacgtggcagccagactattagagctccagttggagtttacaagagaaataaacaaatctgaaataaaggtaaacaaatgactccctggcatattctaaaagtatccttctgggtggcttggcttactggattccccatcttttaattcagttcaacacgtgtgccttgattttatatctctgccaggtggcctgaggtttaggttttggaccgcattctttttccaactcagccaactgttgctgaggactgttttatgcaaagaattgtgctaactgctagcagggatgcaaaagtgggtaaaacatgatctctgcccaggaactgatagtctagaaggagaagcatacaaagcagtttattttaacacagaaggaatgaaaagattcaaagtaattataagctatgtactgaaagaaagagatctgggaaggctacacagaggccatagatttcatctggggcttgaagaagagaattacagtaggtgaaaaggggaaagatgtttctcctttcctagactaagatctttgagggcagagattacatcttatttatctctgtgttcctgatacccaacatagtgcctggcacaaggaaagagtccaatacatgtgttttgaatcaatgaataatgagtggattctagactgatataatagcacaaagacaaagtggataaaagtgcaccttatgtttggggaatgctaaatggtctgatgtggttgctccgaatattggttatataaggaaatgttatgggaaatcaaattttagtaccagattaagaatgccatgctaagaagttatacttagtctataggcaatagttaactatttactcctctaggacaaaatacccttgggttgtgggaagtcagggaccccgaacagagggacctgctgaagccgtgacagaagaacataaattgtgaagatttcatggacatttatcacttccccaatcaatactcttataatttcctatgcctgtctttactttaatctcttaatcccatcatcttcataagctgaggatgtatgtcacctcaggaccctgtgatgattgcgttaactgcacaagttgttcataaagcatgtgtgtttgaacaatttgaaatctgggcaccttgaaaaaagaacaggataacagcgacgttcagggaacaagggagataaccattaggtctgactgcctgggagctgggcaggacagagccatatttctcttattaccaaaaatgggtaagagaaatatagctgaattctttccccagtaaggaatattaataattaacagccctgggaaaagaacgcattccgggggggggcctctaaaatggccactctggaggggtgtctgccttatgcagttacagataagggatgaaacacaccctggtctcctgcagcgtccccagacttgctaggattaggaaattccagcctggcgaattctagtcagaccggttctctgctcttgaaccctgttgtttatcaatgacaatgcatgcacagtgggacatggaacttcattaataattctagtttcgccctgaccttgtgatctcgccctgaccttctgccttgtgatcttttgttgcccttgaaacaagtgatctctgtgacccacaccctattcgtacactccctcccctttgaaaattgctaataaaaacttgctggttttacggctcagggggcatcacggaacctgccgacatgtgatgtctcccccggacacccagctttaaaatttctctcttttgtactctttccctttatttctcagaccagccaacacttagggaaaatagaaaagaacccacgttgaaatatcgggggctggttcccccaatacccttgttcatctttgtatccttagtatctacaacagtgccaggaatttagaagttagtcaataaatggctggatgaatgaatgaattgaagagttttgaggaaggaaattatttcatccaatctgcaccttactttactgataataatccctcgcctttttgtacaattttgtagtcacagaaacattttatcctattatgtcatgaaaaattttattgatatgctcaaaaagcttattaggaaagaaaggcagatattattatcatttcctatagatgttattattctcatttcctggcaacgttattattctcacacccagtaaaaagaaaccaaaactctatttcttctaatatctcttggtatatccgatgatctgttgtatgtgtactggcatataacagggttctcatgggtagccttaatcttgcatcacactcactataatcaggatttctacatatcccaaaaaatagatccaactcgcaatgcagggatattgtactgattacttcatggggatcctggctgtaccataccccacacagcagaagcttaatcaattcttagacatttctgttctttttcttaagcttgatctctctcaacatcaacgaacttatctctcttccttctctttcctctcacaaccttgcccccttttcccacccaaacaaaaaacaaaacccattattttattaagcctttcatttttcagtatgtttatttttctcagcaaaacaaaagccctgtagtttttcttatttccttaaacatggtgttttatttcatccaaatgcaagtgaagaggagattagatttggtttgtggaattccagggaacagattaatgaatgagaggaagtcagagagaaataaatgttagtttaatgtaactttctgacccagcaattcaataatggaactggctgtttcacagagtagtgaactccctgttactggaagtatttggcatgtcaagtccaacttctgacctctaaaaccgcatgtgaccgtcctacatatgttcaaagatgatggtcctgttctcctaaatcttttcttctttttttgagacagagtctcgctccgtcgccaggctggagtgcagtggtgtgatctcggcccactgcaatgtctgcctcctcagttaaagtgattctcctgcctcagcctcctgagtagttgggactacaggcacgtaccaccaggcccagctaattttcatatttttagtagagacagggtttcaccatgttggccaggatggtctcgatctcttgacctcatgatccacctacctcagcatcccaaagtgctgggattacaggctgtgaaccaccgtgcccagcaatcttttcttctccagattaaacatcttactttcttcaagggttccttatttgatgtggcagttcagtaacctgctattgttcttctggacttgttacaatttgtcaatttctcatgcatttatttaaaaaaatttattgagtcgggtcactagaattactaaataagaaaaagaaaattattgagtgacttctatggttcagacgctgttttaggacgtgggaatagagcaatatagcagagaacaaaaacaaagtctgtcttagaagctacagtttactgggagggacagaccctaaacaaataatttttttttaatgtcagagataattagtaggaaataggtagaaaaataaggaaggtcgaagggagaataactgagttgctgttttagacagcataatcagggcaggcctctggaataagatgacagttgagcagagatatgaaggaagtgcaagagtggccaggggaagaacaagccaatttagatagaccgaacaagtgcaaaagctctgaggagtaagcttggtttatttcatgaacaaggaggccagtttatctgaagtggtacaggcaaagagaagagaaagagcaggaggcaaataaccgagggcctaataagccaattatctgtactttgctatttgttctgagtgagatggaaaggcattggaggctttcgagaagaggactgacgtgatttgacttgcatttgaaaagcatcactatggctaccatggggggaaacaaagtttaaaaggcaaagaaatactcagggacctccaaggatactcatacattcctgttaggaggcaataatatgggtgaaaaatgatggtggcaaggacaagggtgataccactacttacccattacccatcagaatagtcagaaagaaaaagacaaacaaggaaggaaagaaaagacagtattggcaaggatacaggccaattagaactttcctacactgctgttggtaaggtaaattgatatgaaacaaccactgtttagaaaaccgcagtatctactaaagttgaacatctgcctcctaggcatatgcctaacagaaacgtttacctatgttcactgaaagacatatacaagattagtcatagctgtaagaattaaagaaagaagagagaaacacgaagggcggctcgacagtcaacagggacaggtttattctgaataaacttgagtggggcagctggccaagttaggtcagagccacactctcttacagactaagtgtttttaaggattcagggtgggagaatttatcagaggcttggactgcttctgtgtttctttgttgtgcttatctgggagggaaagttgtgtgtctgttcccatacatctttctgcagctgcaggcatatcccccgggttgcttttagcttccctatcttagtgcacctgaagggaaaggaatgtgcttattagggcctactgttttactgggagccatcgtatgagggtgaagtttggcagttacccaggagactttccccccacctccctctgtacccaagctgtcttatctatgttttactgtctgctctttctatttgtacttagaagagagtgatttccttgaaatgcacgaggctagaaagggagctggaacttaaagtggcagtgtttgttcgagatgacagtgctcctgctctgtcaatagcagtattctttgtaatatccccaactaaaaagtacccaaacaccatcaagaatagaataatgaaacaaattatactatatttacataatggaatatacaacgagagtagaaaaacttaaactacaagtcttaatataagtgaatgtcacaaatataatattgatcaaaagaagccaaacacaaaaaagtataaactatatgattacatttatataaatttcaaagacacacagaactaacctgtggtgttagaagccaggatattggttacatttgggaagctaatgattagaagggagacatgagggcttctgaggcaatgccctgtttctttctttcttttttttttttttttaagatggagtctcgctctgtcaccaggctggagtgtagtggcgcaatctcggctcactgcaacctccacctcccaggttcaagccattctcctgccacagccccccgagtagttgggcctacaggcgcatgccaccacgcccagctaatttttgtacttttagtagagacggggtttcactgtgttggccaggatggtcttgatctcttgacctcgtgatctgcctgcctcagcctcccagagtgctgggattacaggcatgagccaccgcacctggcctgccctgtttcttaatctggatgctggctatatcaataggctcactttgtgaacattcactaagttgtacatttataatttgagcactttcctgtatcagtgttatgcctcaataaagtttacattacaaaggaatgactcagaggttttgatctgtgcaactggaggctataattgacatttattgaaatggggaagctatagaagaagcaggttttggtgggaaatgcattcattatgtacatactacatttgatatttattagacatccaagttgaaatgctgatagaatgcagttggtatacaagtctgcagttgagggaaatgtctaggctgaagacctaaatttgagagctcactatatagataacatgtaaactcataaagctggatgggatcacctaaggaatagtctagacagagaaaacattcaagtactaaaccctgaggacgccccaacatttaaaggctggaaattgaggagaaaccagtaaagaaaactgagtagccagtgaggtgtgataagagctgagagagtggaatctcagaagccaggtgaaaaaagtgttctaaggaggaagtaaccactgtaacagatacagcagatagtggaataaggtaaggactgatcatcggttattgatggagatcactggagaccttgataaacagcagttttggtggtgtggtagggacaaaagcctaattagaatgagctcaagaaacaaactaatttgagacagtgactataaataactcttttgaggagtttggtttgttttacagaagaacagagaagtaagatattaaaaagaatattaattaaggatatgaagcagtgttgggttaagtaactaaggaggcttatgggatcaagaaaagttttttctcttaataaggtagataataaagtatgtttgtacacttacagggataatcaatagagagggaaaatttgatgacacaagaaaaagagagggcagtggctggagtgatgtcctggagcaggttataaaagaggttagactccaaggcacaaatggagagaccaacttagctaagatcatggacagttcctctagggaggaaagagctagagaaagggatcccttaaatctgtacgtgagccaagagaaattgcaagctcactaccaagttgcacatgtgcttggtaaaaagaaagcttggtaatggctttgataactcaactgtaatataaatcaccatctgactgtcagactaaccccagagtggcatggggtagattcaaacagcctagcaaagactctgaaaatgaactgacactgcaaccacccacagcaggtgagacaaagcttgtagtctgaaactaattgagttatttgcctgctaaaataaactagtcaccatccagataatttaaacaggactcagagtcccacaatctaacactcaagatgggcaagatacaatccaaaattacttaatatacaaagaaccaagaaactgataaatgtttaaaggaaaagaaaacaaatagatgctaatccccaaattatttagatgttagaattatctgacaaaaactttaaagtagctattataaccatcccccatgaggtaaaagttaaacatccttgaaataaatagaaaggtagaagttcttagcagagaaatagaaattatgaaaaagaaccaaatagaaattatgtgaagtaaaaatatttgctgcagagctcattagtagaatggagataacagatggatgaatgaatgagtgaatttgaagatagatcgatataaattattcaatataaagatcatagagaaaaaaatattttaaaaatgaacagtctacagatataccatcctgaatgcacctaatcttgtctaatttttgaagctaggcagggtcaggcctggttaggatttggagggagaccacctgggaatactgggtaatgtaggctgtcaattaaaaaaatgtttttaaacaatcagacacctactatgtaccgataaaattttgtaataaaaaaattcaaaaagtaaacgagaataaataagaataaagaatgtgatgttggccaggagtggtggctcacacttgtaatcctagcactttggaaggccaaggtgggtggatcacctgaggtcacgagtttgagaccagcctggtcaacatcatgaaaccccatctctactaaaaacacaaaaattagccaggtgtggtggtgcttgcctataatcccagctactcgggaggctgaggcaggagaatcacttgaactggggaggcagagattgcagtgagctgagattgcaccattgcactctagcttgagtgacagagcaagagtctgtctcaaaaaaaaaaaaaaaaagaaaaagaaaagaaagaaagaaagaaaaagaacatgatgttttagatatatattaaaaatagtctgggcacagtggctcatgcctgtaagctcagcactttgggaggcagaggtgagcagactgcctgagctcaggagttcgagaccagcctgggcaacatggtgagaccctatctctactaaaaatacaaaaaattagcacagtgtggtagcatgcacctgtagtcccagctactcaggaggctgaggcaggagaatcgcttgaacccaggaggcagaggttgcagtgagccaggattgggccactgcactccagcctgggcaacagagtgagactgcctccaaaaaaaaaaaaaaaaaaaaaaaaaaattaacagagcctcagatacctgtggaaaaatatcaaaagctctaatattggtgtcatcaatatttctgaaatagaggagaaagagactgatgtggaaaagtatttgaagaaatgatggctgaaaacttcataaatttggttaaagatacaaatttacagaattgtaaagctcagtgaaccccaaaaggataaaagcaatgaaaaccccacccaccctaatcaaacttctgaaaaccaaatattaggaaaaaaattttaagagtagccaccaaaaaatcacatgttacatatgggggaacaataattcttatgactgtagatttttcatcagagaccatggaagccagaagacaatggaataacacctttaaagtgctgaaagaaaagaactgtcaacttgaaattttctatctagtgaatattccctttgagaataaaagtgaaataaaaacattctcagataaagaaagcctaaaagaatttgtctccagaacacctgttctgaaagaaatgctaatagaagccaaagtgaaataataccaaaaggaaacttggaactacagaaatgaaggaagagcaacagaattggtatatatctggataaagttaggttatttttctctccttacataaagttatttatgatcattgaaagaaaaaattataacacagtctaggagagtttcaatgtatgtagatgtcatggataggacaattataaacaacagggggaaggtaaagggacccatatacaggcatacctcattttattcattttcccatcgtgttttgtagatattgtgattttacagattgaaggtttatggggcaagtctatcagtgccatttttccaacagtatatgttcacttcctgtctcttgtatcacattctggtaattcttgcagtatttcaaacttgttttttcttttgtagagacaaggtctcactatgttgaccaggctggtcttgaactcctggcctcaagtgatcctctgcccttggcctcccaaagtgctaggattacagatgtgagccatcgaacttagcccaaactttttcattattattatatctgatgtggtgatctgtgatcagtgatcttggatgttactattgtaattgttttggggtgtcacaaatcacacctatataagatggcaaacctatagttgataaatgtagtatgtgtctggctgctccactgaccacctgttccctcacctttctccctcttcttggccctccctattctgtgaggcaatatacattgaaattaggccaatgaataaccctacaatggcctctaaatgttcaagtgaaaagaagagtcacgtctgtgtgcggtggctcatgcctgtaatcccagcactttgggaggccgaggtgggcggatcacaaggtcaggagttcgagactagcctggccaacatggtgaaaccccatctctactaaaaatacaaaaattagcctggcatggtggcagatgcctgtaatcccagctactcaggaggctgaggcaggagaattgcttgaacccaggaggcaggggtcacagtgagccgagatcgcgccactgcactccagcctgggggacagagcaagactccgtctcaaaaaaaaaaaaaaagaaaagaagagtcacatacatctctcactttaaatcaaaatcatgatatgattaagcttagtgaggaatgtacatcaaaagactagataggtcaaaagctaggcctcttacaccaaatggttagccgagttgtaaatgcaaagtaaaagttctcaaagaaaattaaggccaggcgcggtggctcacacctgtaatcccagcactttgggaggccaaggcaggtggatcacgaggtcaggagattgaggccatcctggctaacgtggtgaaaccccatctctactaaaaaaaaaaaaatacaaaaaattagctgggcatagtagcgggtgcctgtagttccagctactcgggaggctgaggcaggagaatggcgtgaaccagggaggtggagcttgcagtgagctgagattgtgccactgcactccagcctgggtgacagagtgagactctgtctcaaaaaaaaaaattaaaagtgctactccggtgaacacatgaatgataaagtgaaacagtcttaatgcttatacagagaaagttgtagaggtctggatagaagattaaacaagccacaacattcccttaagccaaaacttaatctagatcaaatccctaactctctttaattttatgaaggctgagagaggtgaggaagttgcagaagaaaagtttgaaggtagcataagttggctcctgaggtttagggaaagaagccatctccagaacataaaagtacaaggtgaagcagcaagtgctgatgcggaagctgcatcaagttctacagaagatcgagctaagatcactgatgaaggtggctacactaaacaacacattttccatgtaggcaaaacagtcttctattggaagaagatgccatcaaggactttttttttttttttgagatggagtctcactctgtcacccaggctggtgtgcagtggtgcaatctcagctcactgcaacctccatatgctgggttcaaacaattttcctgcctcagcctcccaagtagttgggactacaggtgtacaccaccatgcctgcctaattttttgtatttttagtagagatggagtttcaccatgctgaccaggctggtctcgaactcctgacctcatgatctgcccgcctcatcctcccaaagtgctgggattacaggcatgagccaccatgcccagccagccacctaggacttttatagctaaagataactcattgcctggattcaaagcttcaaagcacaggctaactctcttactaggggataatgcagctggtgattttaagttgaagccaatgtccatgtaccattatgaaaatcctagggccattaagaatgatgtgaattctctgcctatgctccataaatggaacaacaaagcctggatgacagcatatctgttcatagcatggtttactggatattttaagcctactgttgagacctactgctcaggaaaaaagattcctctcaaaatattactactcattggcaatgcacgtggtcacccaagagccctgatggagatgtacaaggagattcaggttgttttcatgcttgctaacacatcattcattctgcagtccatggatcaaggagtaacttcgattttcaagtcttatttaagaaatacaggccaggtgcagtggctcacgcctgtaatcccagcactttgagaggccgaggtgggcggatcacagggtcgggagttcaagagcagcctggccagcatagtgaaaccctgtctctaataaaaatgcagaaattggccgggcatggtggtgggcgcctgtagtcccagctacttgggaggctgagcaggagaatcgcttgaacctgcgagtcagaggttgcagtgagccaagatcatgccactgcactccagcctgggcaacatagtgagactgtgtctcaaaaaaaaaaaaaaaacatttcataggctagagctgccatagatagtgatttctctggatgatctgggcaaagtaaacaaaaagccttctggaaatgattcaccattctaaatgtcattaagaacagttgtgattcatgggaggaggttaaaaatatcaacattaacagaaatttggaagaagttgattccaaccctcatgaatgactttgagaggttcaagtcttcagtggaggaaggaactgctgatgtagtggaaatagcaagataactagaattaaaagtgaagcctgcaaatgtggctgaattctgtaatctcatgataagactttaattaatgaggagttgcttcttctggataaacaaagaaagtggtttgtcaagatagaatctactcctgttgaagatactgtaaacactgttgaaatgacaacaaaggatttagaatattacataaacttagttgataaagaagcagccagaattgagaggattgactccaattttgaaagaagttctactgtgggtaaaatgctatcaaacaccatcacatgctacagagaaatattttgtggaaggaagagtcaattgatatgcaaactttattgttgtcttattttaagaaattgccacagccactccaatcttcagcaaccaccacccttattagtcagtaatcatgaacactgaggcaagaacctccaccagagaaaagactatgactcaccgaaggctctgatgattgttcagatttttaagcaacaaagtactttttaactaaggtatttacattttagacaaaatgtcattgcataacactgtatgcaatgtctaatgtaattagacataatgttattgcacatttattagactataatatagtataaacacaacttttatttattattgtttttctttttagacgaactctttgctctgtcgcccaagctggagtgcagtagcaatcttggctcactgcaatatgcacctcctgggttccagcgattctcctgcctaagccactttggtagcagggattacaggcatgttgccaccatgcccggctaatttttgtatttttagtagagacggggtttcaccatgttggccaagttggtctcgaactcccaacctcaggtgatccacctgcctcggcctcacaaattgctaagattacaggtgtgagccactgcacccggccttaaacataacttatatatgcactgggaaaccaaaaaccttgtgtgattcactttgttgcaatattcactttactgaagtggtctagaactgaacctgcaatatttccaaggtatgcctgtagttgtgagatgtcagtgttttacttgaagtgttaaaacattgattttaagttgactgttaaaattaggtatgtgtattattatccctagatcaacagctaaaaaaaaaaaaccacaaaagatatagacaaccaatatattaaattggaatataaaacatattcaaataatccaaaatataacaggaaaggggacattgagaggcaaaaaaatggaggagacaagcagaaaaataacaaattgtagaccaaaatccactcttatcaataactacattaaatgtaaatggtctttaaaaatgtaaatggtctaaacacaccaattaaaagacaaagatggctgggtgcggtggctcacgcctgcaatcccagcactttgggaggccgaggtgggctgatcacctgaggtcaggagttcaagaccagcctggccaacatggtgaaaccccacctctactaaaaatacaaaaattagccgggcaaggtggtgcatgcctgtaatcccagctactcgggaggctgaggcatgagaatcgcttgaacctgggaggcggaggttgcagtgcactgagatcatgccattgcattccagcctgggcggcagagcaagattccatttcaaaaaaaaaagacaaagatcatcagattggaaaaagaaaaaaacaagacccaactatatgctattacattttattttatttttacttctcaaatgttaaggaaacctattttaaatataaagatataaatatagggaaattacataatgataaaagggtcaattcaccaagaagataaacactgaaatataatatgcaactaacaaagatccaaaataaatgaagcaaaaattgatagaactaaaagagatatggaaaaatccacagtcataactgggagactcaataagtccattctcaatgactgataaacaaatagatggaaatcaaaaaggatatatcaaacctggataacgttatcaactggtttaatataatggacatttacaaaaaacactctacccaagaacaacagaatacatattctttccaagtgcccacagaacatatacccagatagatcatattctgggtcataaaataaactaacaatttttaataaaaccacataaagcatgttctctggctataccaaaattaaacaagaaataaataatagaaaactcccccagcctaaccaacatggtgaaaccccgtctctactaacaatacaaaaattagctgggcatcgtggcgggtgcctataatcccagctactcgggaggctgaggcaggagaattgcttgaacctgggaggtggaggctgcagtgagctgagatcacgtcattgcattccagtccaggtggtagagcaagattccatttccaaaaaaaaaaaaaagacaaagattatcggattggaaaaagaaaaaaacaagacccgactatatgctatcagcaagaaagctattttattttatttttacttctcaaatgtcttatggtttaaggaaatctattttaaatataaagatataaatatagggaagttacataatgataaaagggtcaattcaccaagaagataaacactgaaatatagtatgcaactaacaaagatccaaaataaatgaagcaaaaattgatagaactaaaagagacatggaaaaatccacagtcataactgggagacttcaataactctgttctcaataactgataaacaaatagatggaaatcaaaaaggatatataaaacctggataacattatcaactggtttaatataacggacatttataaaacactctactcaagagcaacagaatacatattctttccaagtgcccacagaacatatacccagatagatcatattctgggtcataaagtaaactttaacaatttttaataaattaaaaccacacaaggccgggcgtggtggctcacacttgtaatcccagcactttaggaggctgaggcagtggatcacctcaggtcgggagttcaagaccagcctgaccaacatggtgaaaccccatctccactaaaaatacaaaactagccgtgcatggtggcacatgcctgtaatcccagctactcgggaggctgaggcaggagaaccgcttgaacccaggaggcagaggttgtggtgagccgagatcatccacataaatggtgttctctggctataccaaaattaaataagaaatcaataatagaaaactcccccagcctgaccaacatggcaaaaccctgtctctactaaaaatacaaaatgtcattgcataacattgtatgcaatgtctaatgttattagacataatgttattgcacatttattagactataatatagtataaacataacttttatttattattgtttttctttttagacgaactcttgggcgtgatagtgcgcgcctgtaatctcagctattcaggaggctgaggcaggagaattgcttgaatccaggaggtggaggttgcagtgagctgagatcgcaccactgcactccagcctgggtaacagaacaagactctgtctcaaaaaaaaagaaaaaaaagaaaaaaaagagaactctcaaatatttagaaattgttaatatacttctaaataatccatgggtcagagaaaaaatcttaaagtaaatcagaaaatatttgaactgactgaacatcaaaacaaaacatatcaaaatttatgggttgcagctaatgcagcgtgtacaggaacatttatagctttacatgcctatgatagaaaaaagaaaggcctcaaatcatactctaagcttctaccttaagaaactagagaaagaacaaattaaacctaaatcaagcagaagaaaaagaaattagaaaagcagaattcaatgaaattgaaaacagaaaaaaatagagaacaatcaataaaaccaaaagctttgaaaaggtgtacagaattcataaactttttgacagatttaccaaggaaaagaaagagagaagacataaattactaatatcaggaatgaaagaggggatgtcacttcagaccctccagatattaaaaggataataagagaatattacaaacaactctatgctcataagtttgacaacttagaggaaatggaccaatttcttgaaagacacaaattacctaaactcagtccagaagaaacagatcagagaaatagtcctaaatgtactaaagaaaatttaattcatagtttaaaaccttccaatgtagagaagaaaactccaggcccagaaggtttcttttcttttccttccttcctccctccctccctccttccctccctccctccctccttccttccttccttctctcttttctttccttttctcttttcttttctttccttttctttcttttctttgtggcagggactcactcctgttattcaggctggagtacagtggtgcaatcacagctcactgcagccaagacttccacacccagcaaatttttttgtatttttagtagagatgggttttcatcatgttgcccaggctggtctcgaactcctggctcaagcaatctgcctgccttagcttcccaaagtgctgggattacaggcatgcgccaccatgcctggcccccaaatggtttcactgggaaattctaccaaatgttaaagaaagaaatagtatcaattccacacaaactcttccagaaaatcaaaaaaacttagctcattttatgaaggcagcatggtcctgatgccaaaatttgaaaaagataacaagaaaactatagaacaatacttcacatgaacatataccccaaaacttcaacaaactacaaactattagcaaaggaatccagaaatatatatatatttttaaaaaataatacttcactactatgtggagtttatcccaggtaatttaatgctggtgtaacattcaaaaatagccaggcatggtggctcacgcctgtaatcccagcactttgggagggtgaagcgggcagatcacctgaggtcaagagtttgagaccagcctggccaacgtggtgaaaccccgtctctactaaaaatacaaaaattagctgggtatggtggtgtgcactagtagtcccagctacttgggaggctgaggcaggagaattgcttgaacccgggaggtggaagttgcagtgagctgagatcgcaccactgtactccagcttgggggacagagcaagactccatctcaataataataataataataaataaatgagcataattcaccatattggcagactaaggaagaaaaaaacacatgataatcctaactgatgaagaaaatgcattaacaaaatttaaaacccattcatgataaaaaaaaaaaaatctctcagcaaactagagaaggaaacttcgttaatccaaaaatatatatatatattggccgggcgcagtggctcacacctataatcccagcactttgggaggccgaggcaggcggatcacctgaggtccagagttcaagaccagccttaccaacgtggagaaacctcgtctccactaaaaatacaaaattagccgggtgtggtggtgcatgcttgtaatcccagctactcgggaggctgaggcaggagaattgcttgaacctgggaggtggaggttgcagtgagccaagatcatgccattgcactccagcctgggcaacaaggacaaaactctgtctaaatatatatatatatatatatatatatatatatatatgtatatatacacacatatatatgtacatatatacatatatctacatatacatatatacatgtatacatatacatatgtatacatgtatatatgtatatatgtgtatgacctccggtgatcccccccccaacctcggcctcccaaagtgctgggattacaggtgtgagccactgcacttgaccgcaaatcacatttctaacaaaggacttgaatccagaatttattttttaacatttttaaaaaattttattttattttatttttggtagagacaggatttttgtatgttgcccaggctggtctcaaacttctgacctcaagtgatcctcctgctcagcctcccaaagcactaggactacaggcatgagccactgtgcctggcctagaatttataaagaaccctcagtagggcgcagtgcctcatgcctgtaatcccagcactttgggaggctgaggcaggcggatcacgaggtcaggagttcaagaccagcctggccaacatagtgaaacctcgtctctactaaaaatacaaaaaaattagccaggcatggtggcaggcacctgtaatcccagctactcaggagaatgaggcaggacaatcacttgaacccgggaggcagaggttgcagtaagccaagatggcgtcactgcagtccagcctgggcaacagtgtgagactctatctcaaaaaaaaaaaaaaaaaaaaaaactctcaaaactcagaaataagaaaacaaacaattttttaaaaaggcaaaagttttgaacaggcacctcaccagagaagatacatggatggcaaataaatatttgaaaatatgctcaacatcatttgttggtagggaattgcaaattaaaaccacagtaaggtatgtctatacacctattgaaattgaaaaaaatccctgacaataccaattgttggtgagaaggcggaacaactgccactctcataaattactggtgggaaaacaaaatgatacagcccctctaggtttcttataaagttaaacacacacttaccataggctccaacaatccctcctagaaattagcccaagtaaaatgaaaatttatgttcataccaaaacctgtacgtgaatgtttacagaagctttattcataattgccaaaactagaaacaacctaaatattcctcaactgggaagtggagtaacaaactgtggtacatccatacaatacactactactcagcaatgaaaaggaattgactactgatacactcaacaacatggatgaatcttaaatccattatgccaagtgaaagaagccaaattcaaaatacaacatattgtatggttccattttatatgacagtctggaaaagaaaaaactataggaatagagaacatatcagtgttgccagggcttaagggtagggaaggctttgactacaaaggggtaacaaaagggaatttgggaaggtgattaactgttttatttttttgtttgtgtgtggtggtgtttacataattctttgcatttgtcaaaactcacagaactctacaccaaaatgtaaattttactgaatgtaaattacaattaaattatatgtatgcaaatctattatgtgtatgtttgtgtatatatatatatatatatatacacatatgaatatttttaaaagctttttcccctcatattactatcaagtcatatctcacagattttgtatttgtacaattattctttcttgagcctgaaattagttaggactgttttgttttgtttttttcttgagatggagtcttactctgttgcccaggctggagtacagtggtatgatctcggctcactgcaacctctgcctcccaagttcaagtgattctctggcctcagcctcccgagtagctgagactacaggcgctcaccaccacacctggctaattttcatatttttagtagagacggggtttctccatgttggtcaggctggtctcgaactcctgacctcaggtgatctgcctgccttggcctcccaaagtgctgggattacaggtgtgagccaccacgcccggtcaagttaggactgtcttcatctctgttaaccttccatttcctctccttccacaaaacctaaactttattattatttgaaacataatttttgagtaagttattccgtctcaagaaggtccaattcgtgttattgagaatggtaaaataatacactacctgccctgggcactttagtgagaatccatttattgggttaactagcagtgactgtggatggcagtgagcaggcctgggagtggccaggacataggacagatgtgctttgatgggagagaagggaaggaaaagccggcagcacagcgatgggaaactagaggccagaggtagaggtggagggcaatgatcagggagcagagatgacagcatgccaaggacatcctgtgctgacttcacaggctggctctgggcataggccagtctcttcctggagctttcattttctctcttcggaatctgtcaactctctactgcaatctgttccacagtcgtatagccaaaatcctcttgctctgtgtctgtttattcaacaaatatttatcttaactgactctaatcacattgtctcctgtttgtcctgcagtgaagcccttttacatctgcttatctcttttgatccaagggaaggagacttaaccctgacttccagagaaggaaatagtctcagaaaggttaagtcatttatctgaagttgcccttttaatactgagtactggactctctcagtatccgcgtactctgctgccccctaccgtgaacatagcaataggttttaaatcacaaaaacacacagcagaacactacacaacactggaaagactacgacactataaatagtgcttacatttgttcatttagcaaatattcagctggacgtggtggctcacgcctgtaatcccagcactttgggaggccgaggcaggtggatcacttgaggccaggagttcaagaccagcctggccaacatggtgaaaccccacctctaaaaatactaaaattagccgggcatggtggcacgcacctgtaataccagctactcgggaggctgaggcaggagaattgcttgaatccaggaggcggaggctgtagtgagccgagatcacaccactgcactccagcctgggtgatacagcaagactccatccccaaaaaataaataaacaaatattaattgagagcctactatatgccagaaataagcaggtattgtccttgtgttcatggagcttatggtgtagagggggagacagaattacacaaaataattacttaattacagtttgaataaatactatgaagtacaaggtgctatatgagggtatagaataagggtatgtagcctggtctggaggcttagggaaatcttacatgaagtagaattcataggaataaattattggttggctatgggggaggttaaagagacatcaagaatgccttccaggtctctggcatgaacaactgggcagatagagcactgttactaagcaggggaagcctagaggaggaagacattatgaatggaaagaatatgaacttggctttggctttttgcagttcgggaatcccacgagacattaaggtatagatgtggaataagcaatcagattcaggagtttgggagcaaggtctatgctagaaatagaaagttgggagttgttgggatacagattatatttgaaactgtggtcatggatgacatttcttagaaaataatagaaagagtagaaggcttataacttccctgagaaactccagaatttaaaaggtcaactggaagagatggagctagcaaaaacttaggacaaggggccaaggaggggaaaatcaggaatgtgcaatgatgccaaagtcaggggaagtgtatttcaaaaagaagactggtcaaccatggtggtaattacaaagaaatcaagtgcaatgactttcttggtctacgatgatttttttggtctgcctagtgaaacagattcagtttcagaggactagaggtggagaagactaggccactacctcttagaaaacctcctaaaggccaccatagcctatggtcttgaaccagtggtcttcatagtcttttgctcacataccacttaaaataattttgataaataatgtgagctgggcacagcggctcaagcctgtaatccaaatgttttgggaggctgagtctggaggatcactggaccccaggagtttgagaccaacctgggcaacatagagaaactccatctctacaaaaattaaaaaattagccaggtgtggtggtgtgtgtctgtagtcctagctatttgggaggctgaggtgggagaattgcttgagcccaggagttcaaggctgcagtgagctataatcatgccactatacttctacctgggcaacagagcaagaccctatctctaagaaaataaataaataaaatttttaaaaaacattaggccaagtgcagtgactcatacctgtaatatcaacactttgggaggccaagatgggagaactgtttgagcttaggaattgaggaccagcctgggcaatatagtatgacctcatctctatgaaaaatttttaaaaattaggtgggtgtggtggcacacgcctgtagtctcagctacttgggaggctgaggcgggaggatcacttgaactcaggagattgaggctgcagtaagctacggttgcgccactgcactccagcctgggcaacagagcgagaccctgtctcaaaacaaacaaacaaaaatatagacatatttttaaaagataatagaaggctattttctgaatcttgtatttttaactgtccccagttctgaacttttttttaattgccccgtgcaatgtatcattcagggtgggtcagatatatgcctttctttcttttcttttttccatttttttttttttctctgagatggagtctcactcttgcccaggctagagagcaatggtgtgatctcggctcactgcaacctccacctccagggttcaagcgattctcctgcctcagcctccccagtagctgcgattactggcacgtgccactgtgcctgactaatttttgtatttttagtagagacagggtttcaccatgttggccaggctggtcttgaagtcctgacctcaggtgatccactcacctctgcctcccaaagtgctgggattacaggcgtgagccaccatgcctggcctttcttatgaagactagcagaactacaattatgaagaaaaagtcggcttggagcctcaaccccaggaactttctcaggtggagtacatctggaagttgaggatctggaaatgaatttccttaaatatatccatgcatgagtaccgcttaccaagccttcatttactttacggctattgcataccccatttgaaaaccagtgttgcaaaggactgggggcaatctgaaactactgggttcctggaacctggcactgattgatggggccagtgggccctaatgagattgcacctccattttaaaagcgtgaaaggtataaggagattcagagataggtgtaaatggcttgcgggagcctccaaaattttcaggtccaggtacctcccaccccttcaagggactgtctgatactattctatggctcctggaatgaagaaccagtcatcaggacctgctggcctctattaaattaagagtccagtcagatttaacaacctgaagatgaggtgtaactgtgaagcaatatatggctgattttttaacacacccatccaaatacatccactccagctgattcattctctcaactcccatgtgctaggtaatgtatgaggtgccagagttacccaaaaaacaaacaaagcacaatccataggccaagtcctgcagaaactctaggagagaaacttttaaagaaataattataaaaacactgtgatcggctgggcgtggtggctcacgcctgtaatatcagcactttggaaggctgaggcaggaggatcacccgagatcaggagtttgagaccagcctggccaacatggtgaaacaccatctctactaaaaatataaaaaaattagctgggtgtggtggctcacaactgtaatcccagctacttgggagactgagagcaggagaattgcttgaacctaggaggcagaggttgtagtgagccaagatcatgccactgcactccagcctgggttacaagagtgaaactctgtctcaagaaaaaaaaaaacaaacactgtgataaagagttaataaaactatgtgcaagagctaggggagtactgaagaaagagtgatttgagtaagaactttgtaagactttgagtaagaactttttaagactttgggaaaacttcccaaaggaggtcacattagagttatttattggcaggcgtgtagtacatcatagagaaaaagagatggcagtggaaggatgttccaggcagaggatgcagcatgtcacatgggcagccagtgtccaagtgacactcaaggggcaagacctgcttcatggacttgtgacctctgtagtcacacagggcccccctcttagaagggccctcacgcttgttttaatgttctgctgtcatcattttgaaattcttattttttttttaacaaggagacttgcattttcatttttgcactgggccctgcaaattacgtagcaggtcctgcaagagggcaagatgaaggcagggagacctgctgggaagttattactgcggtccaagtaagagataatgaaggggctaaatcaaggtcttgtcgtaacagtaatacacagccacaccattttcaacttcttcccagtgtattcctcagtttagatgtagcaatttccccaactggaaagtacttaggttgattttggtgttttgtaattacaaagaatgaggcaattgaataatttgctacaaataattttgtgtttgcacctatgcaaggatatctatctaggataaattctcagaattagaattgatgggtcaaaggtatgctcattttcaaggttgataggcattgccagttggtgacctgaagagagtaaaccaatttgtatctcttccaacagtatggaggagtatctgttttatcatgccctctttaacactctgtagtatccaaccttttggtatttgcagtctgataatgttaagaaagcagtggctgattgtcttaatttgcctttctttaattacaaacatggttggtcatttaaaaaattattataggagtctgttcaggccaggcacagtggctcacgcccataatcccagcactttgggaggccgaggcagatggatcacttgaggccaagagttccagatcagcctggccaacacggcaaaaccgcgtctctacaaaaaacacaaaaaaattagtcaggtatggtggcatgtgcctgtagtcccagctacttgggaggctgagacatgagaatcgcttgaaccaaggaagcagaggttgcagtgagttaagatcgtgccactgcactccatcctgggtaacggagcgagactgtctcaaaaaaaaaaaagagtccatttatatttctgtttgcatgaagcccatttagtccttcgccattattgaattgggtcataggtctttttcttattggtttataacagctgttttacgttaaaaaaataataataaatattttacctagtttatagtttgttgctttatttctgctttttttttggccatgcagatgaaggcctgaatttttgaaacctaagtgaactgttactgctttcactgtataccagtattttgcaatataagccctcttttcagggagtggcctttagagactattacacttatttttttagaagctcagcttgttcatttggagaacatacaatattaaagggaaaaaatgctcagcttgtacttattttttgaagagataatatatccacatgattaaaaagtcaaaagatacaaaaaggtatacagtgagaaaaatctccttccagccaggcatggtggctcccacctgtaatcccagcacttttgggaggccaaggcaggcggatcacatgaggccaggagttcgagaccagcctgcccaacatggtgaaacactgtctctactaaaaatataaaaaatagctgggctttgtggtgtttgcctgtagttctagctacttcggaggctgaggcaagagaattgctccaacccaggaggcagaggtttcggtgagccgagactgtgccactgcactccagcctgggtaacagagcgtgactccatctcaaaaaaataaaataaaataattaaaaaaaattaaaaaataaaaataaaaattgccttcccaccctgtcctcaaaccacttaagcttccctccaggaagtaagcactattatcagttccttgggtatctgtccctattttatgtgtaaatgagcaagtgcatgcacacacatgtattcttttttccgattattacacaaatagtagcctacaatatccaggattctgcacctttgccttttttttaccacttaacattacattttggaaataatgtcctaattattcataaattcgtaagtacttcctcattttaaaaaatggctgcattgggccgggcgcggtggctcacgcctgtaatcccagcactttgggagtccaaggcgggtggatcacaaggtcaggagatcgagaccatcctggctatcacggtgaaaccctgcctctactaaaaaaatacaaaaaaattagctaggcgtggtggtgggcgcctgtaatcccagctactcgggaggctgaggcaggagaattgcttgaacccaggaggtggaggttgcagtgagccgagatcgcgccactgcactccagcctgggcgacagagcgaaactccatctcaaaaaaaaaaaaaaaaaattacaaaaggctgcatagtgtcccattgtatgcattggtttgaatatgcttttaagggagaaacctgagtaagaaatactctcaagtcatttggggctggacattgagactgagtcgggggattggactgggaccttctctagatcctgaacaatcagaccttttccttcctccaggcctttacctcccattttctttttctttttttttttttttttgagatggagtctcactctgtagcccaggctgaagtgcagtggcaccatctcagctcactgcaacctctgtctcctgggttcaagagattctcctgcctcggcctcctgagtagctgggattacaggcacgcgccaccaagccaggctaatttttttgtgtttttagtagaaacggggtttcacccatgttggtcaggctggtctcaaactcctgacctcaagtgatccacccgcctcagcctcccaaaggtgctgggattacgggcgtgagccacagcgcccggccttttaccctccattttctgccaattaaaacttcacacagtcttccattgcttgtaacttttgaacacgtgtgtggtaatgttctgtgtatattgcatataaaactattagcttttaaaatattaccagtttatatagactcatctcaaatgctacttccttttggaaaccttccttgatctccctgatatccccagccagagtgacctcactcccctctgaaatcctatagaatggtgtaatgttttgtggttatttgtcacgccttttatgtgcacaagtcttatcttttttttttttttaacctgaagacggcctcacttgccccagtaccttccacagagtggcttctgagtaatgtttacagaatttttgaggtaattaatgaatgaacaaaggcaccaagggttaaggacatgaatttagtgtcagacacttgggttctactcctggttttgctgttttttaggtgtgtcgtggggtaggtcacttctctcaccctttccttagaatccacttcacaggacagtggtgaggattaagtgatttgatgtaggtaaattgcttttcattgactgttagctgctgaaataggaattcagaggaaggaggagagaggtcaaggagacttcctaagctggactgtgctctccagccaccctctcatttatatttcctttcagatctctactaagaatgtcactctggccgggcgcagtggctcactcctgtaatcccagcactttgggaggccgaggcaggaggatcacttgaggttgggagttcgagaccagcatgaccaacatggaaaaaccccgtctctactaaaaatacaaaattagccaggcgtggtggtgcatgtctgtaatcccagctactcgggaggctgaggcaggagaatcacttgaacccgggaggcaggggttgcggtgagccgagatcacaccattgcactccagcctgggctacaagagcgaaactctgtctcaaataaataaataaataaaacaaaataaaaaataaagaatgtcactcttccttgttcctgcattttctttttatgtctttatcttttgggtaaatttgcctggcttcagggcgaaggccctccagcaccaagagctgcctagtactgcagattcttacgaccactcaaatctttctttcctttataagaaacaagcaactctaccctatggttgagccaatgtgtcagtttcttcctatccaaatggatggcatcctgacatctgcagtgagaggccaatgcaatttggtgggggtaggggcaagggtgggggagttttgcagagcataaagagcacagtatcttggatcttcagcagcttgagttcagttcttaacttttcttgcctcattacaacagtgtcacaacccattttcctcatacattgagaactgctgcagtcaggcacggtgactgttacatggctgttatattggccatggatggccaacatagtgagacctccattttaaaaaaaaaattaaaattagtcaggcatgatgacacgtacccgtagtcatagctactcaggagactgaggtgggaggatcgctcgagcccaggagtttgaggttgcagtgagctatgatcatgccagtgcactccagcctgggtgacagagtgagatcctgtctctaaaaaaataaaaataattagaaagaatatgattggaaaaaaataaaaatacaagtaaaaataaaaaagaactcttgtgaggaaagcatctaacaatgctagacaaaaagtaagtaaccaacaaatgcaagttctccctttaagctcttctccacactggtaccagatttgtactgctaaaagtcctgttctttcctcttattatggaggaattatcctagctcatagccaacctcctcactcatatacatgcttactcaagggcatggcttcagcagttctcctctctctcctgcatcatcaatttttccctctctcctggatcagtctcaatcaacatacaaatgttatgtttcccatcttaaaaacaaacaaaaagtctgttttgactccactaccaactacagctgccacattttctccttcttctttgtagtaaaacttcttgaaaaagctataacctgtatactcaacattttcaattcctcttgaacctactccaatcagatttttgtcccatacactccaccaaaacatctcaagatcaccaacaacctccacattggtaaatctaattaccttctattcatcttcatattatttgatctgtgtgacacagttgattactctctctttcttaaaacattttattcacttggcttccgggagttctcactttcctggttttcttctttttggctcttccttctcagtgtctttggctgattcctcttcattttcccaacctctaagtattagagttgccccaggatccagtcattggaactctttgcttttctgtctacactcatttcctaagtaatttcttcagtcccttgggttttacatattatattgattctgaaaacctccaaattcccacttcactctcaaccttcttcctgaactcaggtccaaatatcaaaatagcctacttaccacatccacttgggtgagctcttcatatttctactcaaacctgtccctcctgcagtcttctttgtgtcaaataatggcaactccattcttctagttgctcaggtcaaaaagtttggtaattggtgaacacgccgtccacgtgcgccttgctgtctctccattatcgcttgagatctccagccttaccgcggcttgaaatggaccccaactgctcctgcaccactggtggctcctgcacgtgcgccggctcctgcaagtgcaaagagtgcaaatgcacctcctgcaagaagagctgctgctcctgctgccccatgggctgtgccaagtgtgcccagggctgtgtctgcaaaggggcgtgcagctgctgtgtctgatgtggggacagctcttctcccagatgttaatagaacaacctgcacaacctggttttttttccttaatacaaccctgagccatttgctgcatttcttttcatattaaatatgtgaatgacaataaaacaattttgacttgaaaaaaaagtttggtaattggtaatgtgactctccgctttgtctcatacctcctatccaatccattaacaaattctgccaactctactttcaaaatctatgattccaaaaaaatccaaaaaaagtgtaaagggaaaaaatacaaaatacaaaaaacaaaaaattaaaaatcaaagtctatgagaatccaactacatctctgtatctctacttggacccaggtctgagccgccatcatcttgtacttggattattgtaatagcctcctaactggcctttctgatatggtcttaaaaccttttctcagcccagcaaccaaagtaattctgttaaaacataagccagaagatgtctcttccactctcagaacctctcatcagtttttgttaagagacagggtctcactcttgctcaggctggagtgcaatgcaatgatgatcacatagtttacgacattctcaaagtcccatgctcaagcaatcctctcacctcagcctcccaagtagccaggactacaggtgtaccccaccattcctgggtaatttttttttgtttttggtagagatggtgtcttgaactcctggcctcaagtgatgagtgagagtatcaggagatgacagatgatgatcaggtgagaggatcaagagactgtcctacctcagtctcccaaagtgctgggattacaggcatgagccaccatgcccagccccatcagttttttatctcatgtagaccacccttccctccataaccttcatctcctgatactctcactctcttccactctaaccacagtgattcttacccttttcctcaaacctaccaggcacgttcttgcctcaaaacttttgcatttgctgttccgtctgcctggattcatttctttcagatatctacatggttcactcccttgttcctccagatctttacaaaaaactcacttttttactgaggccttccctggccactccatccaaaaattttttttttttctctctctctctctctctcacacacacacacacaccattcagatttcaagtcctaaatcctgcttttctcaacagaaaaaaaatgctatttaactacatatatatatttaaatcattttgttcgttgtctatcaccccagtttttttgtttgtttgtttttgttttgttttgttttgttttttcttttgagacagagtctcactctgtcacccaggctggaatgtagtggtgcgatctcagctcactgcaacctccacttcccgggttcaagtgattctcgtgcctcagcctcctgagtacctgggatgacagatgtgcaccaccatgcccagctaatttttgtgttttttagtagagatggggtttcaccatgttagccaggctggtcttgaactcccaacttcaggtgatctgcccaccttggcctcccaaagtgctgggattacaggtgtgagccaccatgcccggcctgctccattataatttaagttccatgaaagcaggaagtgttattagatttgttcaaagctctatcatcccagtaccgagaataatgttcaacacaaaataggtgtttcacataagtatttgttgaacttgtttcttgagtgaaatcaaacgttatcattttgctcctctgttttgggtcattctgcccagaacagagtactcatgccttttggtctcaggaccctctctacactcaaagtattgagggccagacacagtggttcattcctgtagtctctggtacttgaaaggctcaggtgggaggatcacctgagctcaggagtttgaggttgcagtgagctatgattgtgccactgcactgtagcctgggcgacagggtgagaccctgtctcaaaaaaaaaaaaaaacaaaaacattcaggctgggcttggtagctcatgcctgtaatctcagcactctgggaggccgaggcaggcagatcatgaggtcaggagttcaagaccagcctggccaacatagtgaaaccccatctctactaaaaatacaaaaaattagccaagtgtggtggctggcacctattacgtaatcccggctacttgggaggctgaggcaggagaatcgcttgaacctgggaggcagaggttgcagtgagccaagatttcgccactgcactccagcacgggaaatagtgcgagactctgtctcaaaaaaaaaaaaaaaaaaatttcaggactccaaataacttttgaaaattcaggactccaaataacttttgtttatgtggattctgtctattgataagtatcacactagggatcaaaactgagaaattgttaaatatttacatactaattcatttaaaataacaataataaacatgttaacataacatttttatttttaaaaaaataataaaaatttagctgttttgttccaaaacgaaacaaaaaaaatagtgagaggaatgctactgttttgcttttttgaaaatctgttttatgtctggtttaatagaagataattgtattatcctatttacttctcattcaatctgtataatgtgccatgaagccctggaaaactacccagtactctcatgagaaaatgagagtttaaaaagaaaacaatgtcttcgtattattatgtaaatggttgttgtctccatatatatctgttgtctttgtacatagttttccctcccattctacatagcaaactcctgctggtcactcaaggtctgtctcacctgccatctctagacagtcagttgttccctcctccctactcccatttctctattatagcacatattatgttatcttgttatctggataattgtctatcttcccaaccgactatcttcctaaagaaggcaactataacttgatcttctttacatccctagccccactcacagtatctagcaccaaaaagatatttaataaatattagttgaataaagaaatatgaggccaggtgcagtggctcatgcctgtagttctagcactttgggaggccaaggcaggtggatcacctgacgtcaggagtttgagaccagcctggccaacatggcgaaaccccatctctactaaaaatacaaaaattagccgggcatgttggtgggtgcctataattccagctgctcaggaggctgaggcaggagaaccgcttgaacccaggagacggaggttgcagtgagccgagatcatgccacttcactccagcctgggcaaaagagcaaaactccatctcaaaatatataaataaatatgaaaggaggtgaagggaagaggggacccagtttatctacagtgagctcaggcactgatataacatttcttttttttcttttcttgagacagggtctagctctgttgcccggactggagtgcagtggcataatcacagctaactgtaatctctgcctcctggcctcaagtgatcctctctcctcagcctcccaagtagctgggactacagccatgtgccacaactcccagctaaatttttttttttttttttttttttgtaaagacagagtttcaccatgttgcccaggctggtcttgaactcccgggctcaagtgatccatcctccttggcctcccaaagtggtaggattacaggtgtgaacaactgtgcccagccaatatcataattcttttcttttctttttttttttttcttttttgaaacagagtctcttgtcgcccatgccagggtgcagtggcacaatcttggttcactgcaacatctgcctcccaggttcaagcaattctcctgcctcagcccccaagtagctgggattacaggcgtgcaccaccacgcccggctaagttttgtagagatggggtttcaccatgttggccaggctggtctcgaactccagacctcaggtgatccacctgcctcagcctctcaaagtgctgggattacaggtttgagccactgcgccagccccaatataatatttcttgttaagattatcagtgtcaaaggttttccaacatcacactctggggactgttgtggggtggggggaggggtgagggatagcattaggagatatacctaatgctaaatgacgagttaatgggtacagcacaccagcatggcacatgtatacatatgtaactaacctgcacattgtgcacatgtaccctaaaacttaaagtataataataataataaaaaaagaaagaaaaaaacaaacaaccccattaaaaagtgggcgaaggatatgaacagacacttctcaaaagaagacatttatgcagccaaaaaacacatgaaaaaatgctcatcatcattggccatcagagaaatgcaaatcaaaaccacaatgagataccatctcacaccagttagaatggcaatcattaaaaagtcaggaaacaacaggtgctggagaggatgtggagaaataggaacacctttacactgttggtgggactgtaaactagttcaaccattgtggaagtcagtgtggcgattcctcagggatctagaactagaaataccatttgacccagccatcccattactggctatatacccaaaggactataaatcatgctgctataaagatacgtgcacatgtatgtttattgtggcactattcacaatagcaaagacttggaaccaacccaaatgtccaacaatgatagactggattaagaaaatgtggcacatatacaccatggaatactatgcagccataaaaaaatgatgagttcatgtcctttgtagggacatagatgaaactggaaatcatcattctcagcaaactatcgcaaggacaaaaaaccgaacactgcatgttctcactcataggtgggaattgaacaacagaacacatggacacaggagtgggaacgtcacactccggggactgttgtggggtggggggaggggggagagatagcattaggagatacacctaatgctgaatgacgagttaatgggtgcagtacaccaacatggcacatgtatacatatgtaacaaacctgcacattgtgcacatgtaccctaaaacttaaagtataataataataataataataataataaaaagcttttcctagcagctggtcagtttaccatatagttcattaagtgaattccaaccactcatgtggtctttcaagtgaagtggagaagacagaggtcattcatttcattttatgaggcaaccaaggcccaaataaatgaagtgacttgctgaaaggcataccaaaagtcagtgacagagccagtgcttgaatcaggtatctgacgttaagtcaagtgctgtttccattttatcccatgctcatcatggtgactggaggctgcaaagtcagagttcccgtgattctatcttggggtgttgctctgaaaccttctaaacctcctcttgaactgatttcacagcagtctctggaccgtcctcttactaaggactatcttagggatccattttataagcaaccattgacttctatcagcctcttctttccttatcatcaatacctactgccattcacatccgccatccttgggagctggtcaaggtggaccaccacagtgctatatcatcatcggcagttccacaagcatttggtattagaggaaaggagaagaataagacagagctcagtccagtctgttccccttcattctttgaatatactatttcttctttctggaatatatcccctcccaaaccttccaactttggcagttcattgctctttcctcagtgtttccacaacactttgttctcattcgtgtcataactcatcatgtaaccacaatgatttgtctctatcatctccctaccgggactgtgagctgttcacctcaatggtgttaatacagtcttcagtctctttgatttccctgagactgtcaactccttctctctctctctttttttttagacagagtctcactctgttactgggctggagtgcggtggcgcaatctcagctctctgcaacctctgcctcccaggttcaagcgattctcaggcctcagcctcctcagtagctgggattacaggtgtgcaccactatgcctggctaatttttgtattttttgcagagacagggtttcaccatgttggccaggctggtctcaaactcctggactcatgtaatccgcctgctttggcctcccaaaatgctgggattacaggtgtgagtcaccacgcccagccaactccttccttttctttgaacctctcttcttctttccggtgatactccacaatcctgattcttcagtctttttggacaatctttagattcacttttggcttgacttttctcaggctctgaatatgtatgtctcaggatggaactcttggccttttgctctcttcaactctttgctttcagcttcaactaccgtatttacttgaaggtgtccaaaatatccattctccaccttcttcgagaactcattcccatacccatctcacagatcttgtggtcaccccagtttcagcaagtctaaaaccgagctccttgtcacctccttcaagccagttcctccacatgaggactccgtttctgtgaagatgctaccatccatctttctcgatttgccatcactccaaactcctttccctcttcttgtatgcccattgtctcttaaatctgtctcttttctcacccccatcctagaaaaaaatgggttctgaagtcaaatcgattcagctctatcacttatgaatcacgcaagtttggcaaacttattcagagtcttccacttctttatcctaaattaggggtaataatagcatctatttcatagggtttatctatgaagattaaatgagatatcgtggaggaaagtgcttagcccagtaactagtatgtattaggcactcaataaatgttaattattattgttatccttatttccttatacttagactattacactagtctcctaaccaatctctctgcctcctctggtcattattctctccactgggaggggaactaacatggaatatctattaagtgtcaagcacctcatgctgaaagcaatcttatacagtaatagtagcatcattttataaaaatggaacagagccaagatatgaacataggtctgacgctaaagcctgtgcccttttttcatctccaaattaccacgtaatcataaaatactattttcacacatcatcctgcttaaacacacacatacacacacacacaccacacacacacaacctttaatgaccaccctcccccattttccttcagaacacaacccaaatttattatcctagcattcactgtcttgtacaacttccctcacttcccaacactttcctataggaaccctgtgctccagagaaacttatctgccgcctcaggcacatcctgtacaccctcaacttcctccctgaaatgccctctcctctcccctcccctggtttaaatccagcctttccttcaggtcctagctagagtcccaccctcctccattacactttttcctaacttccccagcccctcatcaggtctccctcgacccctggagcagccgcctgtatccttgttgacacgtggtgtttgccattctgtttttctttgcgtttatgttttctcatcaagctgtaaacctctgcactccaggaaatcggccttctcttttttgtttttgtttttgggtgtttttttttttcctttcagcatcccaagtagcccagagccctacaaatagaaagcgcttgataaatatgggttgttttggatgaaagatgatcttcccagctggatgagctctttccctctaggggtgagggactgagcttcacctcaacttcacctaatgtctcacaggaatgccccctcttaaacgctcctcaggtcttctctacccctttcccccaccaccccggcccaggagagccactcagagctccctctccggagtcaccctctcagacccagggctatttctttagcttgctctcgaaccccgcctttaccccagagccgctcctcagtctcctcccccaggctgcctctcaggccccctctcctccaatgccactccctaggaccctctccccagggttccggacccccaaccccggatatgttcccccagggccatccagttgttctacctccaggattactgatttagcctcttccccctcctgctcagggctacccccagaccccgacctccagttccaccccttcggaccctgcctctagaactgttcttttagcctctgcaaccccctccccagcgccgctccgcggcccctgccccagggctggtcggggagccactgccctcgcaggtcccgcccgggtgctgcccccgcgcccccggccgccccccaccggggcggggcgcggcggcggcgggggcagggaaccgggcagcggtggcggtggcggtggcgcgggcggacgaggcggaggcgcccttcgccgggcaggtggggctggcgcgcggggccggggcgcgggctcggggcatccgggcagggcggggggcggcaccggggacgggcctgggccgggccgcacctactgccgaggtcgcggaggcggcgcgccgggggtccgcgccttgggtccgggctggcgcggcccagggcgggggctggggagggcctcgccgagggccgccgaggccgggagctgcttcagcaccgcggacaggggcagcgggcgggggccgagcacgagggtcgggtttgttgtgttggcagtggggtgtgtggcctgcatgactatgtgcgagggaaaccgtacaacgcctcggagtaaatagtaagcgcagccagtctgttgtgggttgggagaagaaaccgaggatgttcaagctggagaagggggagggggagggcggaggaaggactcgatcactgtcttcgtagctgaagggctgtcaggtggaggtaggatagacttgttctagcttggccccacagggcagaactagggccagcgggagtgggggttgcaagaagacaaatttgggctcgatataggaagaagtttgtaacaattggagctgctcaaccagcttaggaggcggcgagctgctcatcactggcatgtgcaagtaaaagctctcggaggggattggatggaggcatgcataatgcttgcatggatgcatacatcatcatcacaataatgccagctagcatttactgaacactcactatgtgccaggcctggtgctatgttttatacgaattatccaattcaatcctcataactactctatgaaatagctgcaattattatccccattttacagatggggatacagactcaaagagcttaagtaacttgcccaaggtcacacagctagtgagtgatggaattggaattctaacctaggcaggctgactctagtctccccttatttacccatgaccttatcctatatctcatggggggtgcagttggactaatttctctagtatcttccaacctagaggactgcaatattctaataaatgatgttgggacaatggtgttttgctgaggaaaatcagagtgatagcctcgccaccctaagagatggagtatatttgttgaagcaggcagtctgtttgtttagaagaatctgcctcaagagatattcttaattgggcatggagctcagggggtcatacgtgcactgaaattgcgtacaaatttgtaagtgcaaatgtgtgtatttctaggcgaggacccctagatttcttcagcctctcaaagggttacaggttccacaaaacaacaaaaaagatatggtgtgtaaaagaacctttagtgccagttggcagttgtcctccaaagattttataattgctggttgacttgttgtggaaactttgcttagcctctttgtgttttcacatgtgttttatcacatgttaaagtaatgcatttcctaagtttataccctagaagaaagattgctttagactgcctgagtgcacaggatgaggtggaaagaccctggcctgggattaaggaggcctgggctctgatctgaccttggcccccattggtttgtgtgaccttgagccatttccttgccctctctaggcttgaatttcaccatgtctaacataaagagatagagctagacaatctcaactctgaaacttttttattcctacaatatttcaagcattaagaggaagctagtccttacctgtatcagttttataggctttgattattccacctcttagcctttgtctttttaaacttaagtttccccctatgacacgagacccctagaatagccacactcattctctgggtcattttagttgtccttttctagataccttttggccctaattttcaatagatgtcaacttgaccattgtctccagatacaggaccctacggttttgcataaaggaaggttggtttcttctttgctctcctggtcccatcctgcttcccccttccctctgtcagctttcctgatctcaacacactaggccactgcctttagggaacaatctataatagctcccggagccttttcctgggtcaaaactgatagcctggaacacaacaccctgtatgtggattatttttatcggagtgcattaccttacatttctccaccttgacgtttgtctgccatcttgcattgcactcagtaacttccttcaagcattcgctcactctctctctcccttcctccacctcttcctccttccttctcttttggcatagcatttccctgtctgaaagggcttaatatgatctgaagtcttgaaattttcactttgctatatttcttctggatcacttataaaaaatttaagtgagacaggtcccagcatggtctcttggggccccctgcactcttaatcccctttcattcacggaagtgaccatttatatctatctattgttttctaagtgacaaaaacatcatccttaatttgacaatgactccattttaaatgtctaatacattgtccaaaacttcctgaaagatagacaaattatatccactgcttctctcaataatttgtgcctaattatcctttcactgaacactaggggatcacttgattgacaccttatagaaatattgttgcttttaagccggcagataatattgcttactcctctttctgtcttttaagccctctggagtctgtctccaccctacccctccattagcaggccatatttcccactgcttattgataacgcatccttactcgacaagctcatctctcctttacccttagacaggctgcccatatttctctggacattgtcacatagttacttctgcacccctacccgttcatttgaaacctttccttaaagtttcagctcaagccctgcttctccaataaactttccctgatttctctagttgtcattttcttctctcttctccaggaaacatttttaaggcagccccagccagtttgtcatttatttatttacttatttttatttattttatttatttatttttgagacagagtctcactctgttgcccaggctggagtgcagtggggtgatctcggctcactgcaacctccgcctcccaggttcaagcgattctcctgcctcagcctcctgagtaactgggattacaggcatgcaccaccacgcccggttaatttttgtatttttagtagagaagggttttcgccgtattggccaggctggtctcaaactcgtgacctcaagtgatccaccttcctcagcctcccaaagtgctgggattataggtgtgagccaccgtgcccagccctatttattttttaatagttaaacattatttttggggagaggaaggttggttcttaggcaaggctttcttgaccaaaatgttttatttttttacattgaacaaaatccctgattctcaatgctcatcattaagtattcaatgagcaatcaatgattctactctttatcctttatctcaaaaagttacatggatctgaaataggcactcatgggcatggggctccaagcccccttctaaaacccttcttagagatgggactcattgccaacttgtactttcttcggtagaaatcaagcctattccttttggcagtggttccacaagctcacccttgagttccttcagaactctttaggtagtcttctaatggtagtggcatcaatagaaagaaattgagagataaccgtgaccttagagatcacccagtacctactacagcacttactagatacttctttaattgagttgcccaagggcacagaacgtgatagtagatgattcggaactactgtagaacttttcctagttctcctgatttctaaattgaaagcatttttcatcatcattgatttttcatttcgtatctatgatctttcattaccaagccaaaaaatttttttattcagtctatcttctcctttgctttatttttctccacaccccacaacccccgaccccttgaagctcaacaaacaggatcctatgctttctttagtctttcttttttatcttacacatcaagaggtcccactgattctctaactggcttccttcatttgatttattaaaagcaccacttctcttatttgctgagtagaatgctcctcaaatacttttctggccttcctagtttccaacttgattctgaggaagatcagaacaggatgaaagagacaagtcaattatcacaggccacatgaataagtaacagagtgtgactcctagacccaggacttatggattcctgcccttgagactggttttgagtggtttgtgctgaggagatggagaacagtctttggtttgaaactgtagtcaaggaagattgaccccgaatgattggaggggtaagagagtgacctactaagaagcaccaacgtattcccaaatcaaaatattctttcactgtgatcatggcctccagtatatcttcattcttgtctggaaaaaaaaaactcactattaggaagttttcccttttacataagctggatctagtctactgtatttttaattcattttctcttatttttactgtggggtttcatattactttaatagctgtttatatttgtaaggtgctttgcacttcccatatgccatgtatgtggccctatttggtcctgggaacaataccatgaggtagataaggaagacattgtcctcattttataggtgagtaaaaggagactcaaagatgatgtgaattgcctatcatcttgtctaaggacccacacatagctcataaacattaaagcaggccaggcatggtggctcacacctgtaatcccagcactttgggaggccgaggcaggtggatcacctgaggtcaggagtttgagactagcctggccaacatggtgaaaccccatctctactaaaaatacaaaaattagctgagcctggtggtgcatgcctgtaatcccagctgctgaggcaggagaattgcttgaaccccgggggcagaggttgtagtgagccaagactgtgccacttcactccagcctgggcaaaagagtgaatctccgtctcagaagaaaaaaagaaattaaagcaaataacagaagctaggttttctgttcttgggctcagcactctgcccactatacaagtttcctgttctggattattattgtagccttttagccagtcttttctactttcaagtatgtcctactctggtccttgaaagaggtatttttagaactaataaaagtaaattataattgtacccaaaagactaatcttaggaaatgcctagccctatagtatggtattgtttgaactcaaaacaggaagaacaaaccacagccaatatctcctcagtacctagcacagtgcatgatacattctggacatgtgataaatattttaaaattaattttgttatctaatccccatcaacttctttgaatagtgcttggcacacaaaagtcgctaccttttgtgaagaataaatgaatgcatgctagaggtataacaaggtgccgggaagcaccgaagagggaggagatgaggttccccagttgaggttcgggaagccagagaatgcttcaggaagaaggtggtatctgagatgaacctttgagggaggagaatgatggagaagggtgagtggggcagtccaggcagaataaaaaatatgaaccatggctccacaaaaatgcatggcatgtttaggaaacagtggataatttgatgtgcctgaatcatcaagttacttgctgtttccagtaagagtgtataaggagaagaggctggagagggagactgagagcagattgtgcatttggcttttgtccaaaggctgaggggagtcattaaaggtttctgagcagaggagcgacctgctcagagccatgttgaggaagtggagggactggagtttgttcctgagttgttctggctgctggctcctgccctgaatgcttttaagctttcttagcacaacttaggggcgagtactcattttagggctcaagtgacccgcccaccttggcctcccaaagggcttacaggcatgagccctggccttgcctgttagcagtaatttaaagactcaattctatgccacaaacacttacgaggcataaagggcaccaaaagtacttggccagaaagtcaggagttgttctttactcctttctctctttatacatatgtatgtataaagatcatttgaggccaggagttcgagaccagcctggccaacatggtgaaaccctatctctattaaaaatacaaaaaaattagctatgcatggtggtacatgcctgtagttccagctacttgggtggctgaggcacaagaatcacttgaacctgggaggcggaggttacagtgagccaggattgaactactgtactccagccaaagcaagactctgtatcaaaaatcaatcaatgaatcaatcaatcagtccactcaggagtcagttatatctgaagcctatatggcaaaaactaatgtttgacaaagctggctggtgattttccaatatatattgttattttatgcctttctgaatgactgaaatattgaataataaaaaaaattaaaaacaaaccaaaatctgatcaccttactcccaccctcacctggcttaaaatgactcttaggacaaagattatactattattactgtactactatcacttcttccttttagttttattatggaaaactttcaaatgcatatgaaaatggaaagaacaatattataaactcccttggacgcagcacccacaaggatcacttgagtccgggagtttgagaccagcctgtgcaacatggcaaaaccccatctctacaaaaaaatacaaagagtagctgggtgtggtggcatgtgcctgtagtcacagctacttgggaggctgaggcaggaggattgcttgagcccaggaagctgaggctacagtggacagagatcacaccactgcactcaagcctgggccacagcgcaaaaccctgtctaaaacaaaaacaaaaacatgcttaatgaagccgatgaggccctgcatgactgagtccttcccatctctctgacttccttttataccacccattctccccattggtcactagactccagtcaccctgcccttccctctctttttctaatatacaggctccttcccattcaggaattcagtaaggtactctttcctggagtctcattctcagccttcacctagcctcttctgttcattcacagatgtcagctgagatgtcatgtactcagggaggccatccctgatatcacagcctatatctcctgccacacacttttgtagctcctggttcttctctttcattccacttatcaccactgtaatgaaatgtttagtatttccatgtctatctctcccaccggctgtaacttccatgaggatgagttcaaaggggactacaggcatgtaaaccattatttataatgtaatacaaaatatgctataaatgaggatacatataatgccattgggagcacatagaaagtccatttaaccccagacagatagccctccctgatgaagtggcattcaagttgcattttgaagtagcgcaccatggggaggccagagtacatatgggaaaggagttctagggagagggaatgaaataaaggcacagaggcaggactctgcaggatatgctcaggcaacacaattaggtcagtatagctagaggttggggtacttgaggtgagcaataaagggtagaaggtacaggacagaacatgaggctggcagaaccaggcatggtggctcatgcctgtaatcccagcttctcaggaggctgaggctggaggattgcttgagaccaagagtttgaggtcatagtgagctatgattgtgccactgcactccagcctgagcgacagagcagaaccccatctctacaaaagaaaacagggctggaaaggtgcattggcatcacattgtaagggttgttgtgtcatgctaaagaatctggactttaagactggcaatgaggaaccagaagatcggcttcacagtcaatccacttaggctaaaataatggaactttttaacatgacttacaggttatttagttcaaccatctccctgttgcagttaagaaactgagacttggtctggctgtggggctcacatctgtaaccctagcactttgggaggccaagctgggaggatcacttgagcccaggagtttgagaccagcctgggcaacatggcgaaaccctatctctacaaaaaatacaaagattagctgtgtatggtggcatacacctacagtcacagctacttgggagactgaggcaggaggattgcttgagcccaagaagttgaggctacagagagcagagattgtaccactgcactgcagcctgggccatagagtgaaaccctgtcttaaaaaaattaggccaggtgcagtggctcacacttgtaatcccagcactttgggaggctgaggtgggtggatcacctgaggtcagaagttcgagatcagcctggccaatagggtgaaaccctgtctttactaaaaaatacaaagaattagctgagcgtggtggtgggcacctgtaatcccagctacttaggaggctgaggcaggagaatcacttgaacccgagaggcggaggttgcagtgagccaaaatcacgccattgcactccagcctgggtgacaagagcaagactatgtctcaaaaaaaaattttttttaatttaaattttaaaaaccctgaggcctggccactggtctttgtcttcacttttcccttttcttaactcaccaagaagtcgagcctcaggggacagaaaattagcagatctgcgggagggccttggacagggtgaggaagactaaggcctctccttttccagagagtgaatgagaccatggccacactcctgactgtgggcagaggcctccccagaactgcaaaacttggacatcccagtgctgacccaaaaccccaaatgtgccacctccccgggtatggtgatcatctggcttgtggtggcctcctgggagtgggccaaggacattctgcagagcgccagggaattcccgctagtgcacttaccacccactcaagagccgatggcagccaacaggcaatgctgcgccattaaggtgtttgtcaagaagctaagctgggcattgtgggcgatcctgagggccctttttagattggctgtaagtgaagaaaaaaaacagcatttggaggcaaactagagctagtgcagagggtgtagcatgacagaaaaccctctgagaggcagagatgcttgcctccatgtctggcttccttaccaacttgctctgtgattttgaataagtcatttcccctcccggagttttctttctctcttctgcaaaacaagtatgttaaattagatgatctctgagtattggtgaccagtgcattttctagatacctgaatgattatgccttcagtatgaaattttacgaattagttatataactcaggtgggctcagcagcaaggctgggacctcagttatatgggtagaggaggaagcagggttttggtgggacaagaagtggagggaactgacacagtgataggacccatccctgaggagtcaccagaaagacccagtgatttggtctggcagcaataaccaaacgtggtggtcaaagaggagaaatgacttattaaaaatcaccaagggctgggtgaggtggctcacacctgtaatcccagcactttgggaggctgaggtgagtggaccacctaagatcaggagttcgagaccagcctgactaacatggtgaaaccctgtctctactaaaaatacaaaaattagccgggcatggtggcgtgcacctgtaattccaactactcgggaggctgaggcaggagaatcacttgaacccaggaggcagaggttgcagtgagccaagatcgcaccactgcactccagcctgtgcgacagagcgagacaccatctcaaaaaaaaaaaaaaaaaaaaaatcactaagagcaagttggtgggggagctgggaatggagccaagcgtctctgcctttcagcggttctttccaaggagtatgggagcaggaatagacaataacattgtacgaacacttactatgtgccagaatctgctaaatgcttcttgctgctgtaacaaattaccacaaacttatttctaaaagcaacacagacttgttttcttacatttctggaggtcagaagtccaaaatgggtcttgctggactgaaatcaagttattggcagggctgcattcctgctggagtttctaggagaggatctcttccttgccttttccagtgtctagagaatgcccgcatcccttggcttgtggccccttctagcagcagcagcactgctataacctatgtctcccaacaccttctctgactcaaaccccctgccttcctcttataaggatgcttgtgatttcattagacccacctggataatccgggctaatctcccccatctgaagatccttaacttaatcatttctataaagtctcttttaccacataaggcaacatattcccaggttttggggattaggatgtggctgtctttgaagggtcattattttacctaccacagtgcatcatctcactgagtcctcctaacagcccttctttaaacatctgtttaacagatgaggaatgtgatgcttagaggagttaggtcatttgcccaagggcactctgctggaaagagaaaagttaggtaatatttggtatgtggtggcatcttggtcccaagtgagctgtctttttagataggaccccattcagctcccaagtgtattgagaatacagtctaactctgtggaggaggctgtctaagaactaggcagggaatctgagaccctgaaaaatagattagggtcacagcagtctcagcttagaacttgaatgctagagagagaaactgagggaaaaaacccagttgtaagcattaagccaatatagcaatggatgaggaagaatgatcttaggccaccattcatgcctgcatacagtgatacaataatatcttagtgttgggggttgaagctgctgatggaccatttgctcaagttaggattgaccaaggagatggacaaggtgagggactcagagataactgcagagccgaggcacagagagcagaggctggctactgagccagtgctaatagaagacttttctaaatgggtaacatagtcaattataagtgacactgaacaacatgtccatttcgtcatggttatggcaggccctgtgctagctgttggggtgacaatgatgaggaggacatatatgcattttagagtcaggaggaagcgacagatatttcaacatgtggttacaatacagtgtggtaagaattgcgataaggaaacagatgggggactgacagggatgtacaaggaccttctgaaatagatgtaagaggccaaggctccccaaagagggaggaggggagagtgaactgaatagaaggaacaatacgtgtaagggcctgggagaactggaactcactggaacacagagcactaggtggggaaagataaaaggggttgcagagggagtcagggaccatatcataaaggctcttaactgcagagatggaaagctcttagagccacctcagggcattcacacttactgttccctcatcctggaacacgctttcctagtagccacagggtccactccctcacctccttcagatctcttgctcaaatgtcacctgctcaaagagattgtccctgatcaccctccataaatagctgtcccactctccatctctccaaccggctctattcttcacagcacttattcccacatggttcttccactagaccataactactagaaagtaactagaatgctgtttttggtttttgtttttgtttctgttttagacatggtctcattctgtcgcccacagcccactgcagcctccaactcctgggctcaaggatcttcctgccacagtctccagagcagctaggactacaggggtgtgtcaccacgcctggctacttttttcaatttttttttttttttttagacagagtcttgctctgtcgccaggctggggtgcagtgccgtgatcttggctcactgcaacctccacctcctggggtcaagcgattctcctgcctcagcctcccgagtagctaggattacaggcgcacgcccggctaatttttgtatttttagtagagatggggtttcaccgtgttggccaggatggtctcgatctcttgacctcatgatctgtctgcctcggcctctcaaagtgctgagattacaggcatgagccaccacgcctggctgtttttcaatttttttctttttttgtagagaggtgtcttgctatgttggccaggctgggactagaatgtttttgtttgctcttttagccctagcacacagtacttggtacatagtaggtcctcaataaatatttattgaatgaagggacagaaataaacatttgatgtttaggaggtaggacccatagttctttggtaaaagactagtgtgctgtggctcacgcctgtaatcccagcactttatgaggccaaggcagatgtatcacttgagcctaggagttcaagaccagccctagcaacacagcgagacttcgtctccacaaaagattaaaaaagaaaaattagccaggcgtggtggcaaacgcctgtagtcccagctactcaggaggctgaggtgggaggatcacttgagcccagaagttcaaggctgcagtgagccatggctgagagcgagaccctgtctcaaaaaaaaaccaaccaaacaaacaaacaaaaaaggaaactggatgtaggcagtgaaggagagggaagagtcacaggtcatatgaggctgctggtttggacaactgggtagctgatggtgccataccctgacatagcacaggcatattgagctcactattgtctgagataaggcattgcactccaggagtgtgaggtataggaagtcctgggagggggaagggctgcctgtccaacactctgaccgtacggaatatgcctgaattctgccatttcttagctttagggctctggatacttgtaggcactgccagagctctgcctcttgccacccccattgccacttctaacctcaccaccacctctgctgtctcccgctctcttccctcttctgtgcacattttgttctccttggtattctctgctctctcctttcactgccaccactccgggacttctcagctttggcttctcaggaacccaaatcctgccttctggccggcagaccagtcacaccatattgtctatgatctctacgtctttggctcagcccagctattttggtctctgcttgcactctgagatttttcttactttcctctgggtttacacctctttctgcacttaaagggtgacagacatcttaagagttggttaactgagctgtaaaggttagacttctgacgtggctgatgattgattaatggatctaggtgtaaagagatgaaagcaaggtcattctgtctaaaagtgaatgggacttttttccttcagtgggttttatcttttttttcaaatggaacaatggaacctattgcctcatcaagcaaggaagtcaaatcacaatagattgaatttcagcaagtgttttttgaaacctctaatagataccaggaattgtgcttggtgctttcagtgtattactaaatcttcccaagatgaagtcccttccttgatatccaggcagtgcctcctagatcaactgttcattcattaactcagtgattatttcttgtgtcagacactgtgctaaatactataacagatacaaaaataaatatgacaccatctctgttctccaggaactcaatctagtgggaaaaacagacatatccatgactgggtatgatacattgtggtagctgtgtgtacaaagtactgcaggagtaaagagggcacccactagctctgacagggagagctaaggaagatttaacaaaggaggtgacattgagctagaccttgaaggatgagtaggagtttgctaatgtgcataaagagaatgggttttggaggcagcagaaacagcctggaactgtgaagggcagagagtgctttggacttgctatgactggaatgtagaacacttgctctagcctcaggagttctgcccagagaaggcagaggattgtctgggtcacagagaaagtgagtggcagagacaggattaagcagcatgaattagaattgtccgaccccgatccatcttccttagcctctaatacacacacacagacacacagacacacacacacataatgctagtccaacttcttgtcctgtcccctggcttagatgctgtcattcgactgcccccaccccatttgcccttctaggagtgtgcccctaggctctgaggattgtccccagagaacctgggagagaaacagagcctagagaatattagagaatacactaatactggcccacccccaccatgtgtctgatccatcccagtgtttagttctggcctagacatttgcctatgacctgagtccatagatcctaactcctgatgtggccacgatagactctgtgatgttcgtaatggatttggatgggctgtgagatgctccttgcttgagtatcccagaaaacgagctgcgtaaaccaggttgccagctttttactgaggaggagctacttttaattcccagagcactggaacgctagagtgggcttatgtagaagaccccctgttcctcacttcctaccataagcaggaatgaaaatttttaaattccatgctagcttcgaggtggatgctcaaaaaatactccattggctgactggcttgtgagtagttatctgttcagaggtccctagctatttcccaaatggtgtaattcatcttagtcaaatttttagagaaccagtagagtccgttggcagatagggaggcactggatatattttaggtttgtaccacacctcttttggggatgtcttgaggcagcttacatattaaaacataatgtcttgtggctctacgcctgtaatcccagcacttacggaggccaaggcgggtggatcacctgagcccaggagttcaagaccagcctggccaaaatggtgaaaccccgtccctactaaaaatacaaaaattacctgggcatggtggcacatgcctgtaatcccagctacttgggaggctgagacaggagaattgcttgaacctgggaggcagagattgcagtgagccgagatcgtaccactgcactccagcctgggcaacagagtgagactccatctcaaaaaataaaataaaataaaaattaaatttaaaaaaagcccataatgtctttatgtaagtcttttaaggatgaaacataaaacttggtggtctgaaggatgaaaaaagtaatggttacttccaaacatccccatgctcaacaaataagctataaatttggctgaaaaattcctgggagaaagacaaaaagggaaacgcattgggttatccagtgttccttttcttataccttaaagtatacagaatatcctatagggaaaacattttcctcaagctaaagcctaatagaaagtaattgtgtttggtcctaagaaagttgagtgagaaggtgaagggtatgtaattccatttagccgtcgtttctccgtatccactcagcaccaggccctatgcagtgtccccagtcttctgggagatgctgtcatgtccataagtcacccaagagaaagaagacttgaccgcaaaagatgaactgccctccataggacccacaagaactggctcttggtccaaggagcacatgggagggcaggatggctagatttcaaaaagcaagagtcaaatggccaggcacggtggctcatgcctgtaatcccagcactttgggaggccaaggcaggtgtatcacttgaggtcaggagttcaagaccagcctggccaacatggtgaaaccccatctctactaaaaatacaaaaattagccaggcagtagtggcatgtgcctgtaatcccagctacttgggaggctgaggcagaagaatcacttgaacctcgggggtgaaggttgcagtgagccgagatcacaccactgcactccagcctgggcaagagagcaagacttcatctcaaaaaaagaaaaaaaaaatctgctcagaatgtgctatgctctcccacatttccaggcaattgcacatgctgtatacttcaaggcttagcttaaatctcatctctatctggaagccgtccctgagttcccctttctctgtggtgctctgctccccaccatggataagacacccttcttttgttctcccatagaactctatgcacacttgctttttagcattgtatttttattgtgggtttacttgtcagtctctgagttccttattcatctttattttttcagagcctcgcacagtgcctagcctgtagtaggtgctcagttaatgcttgttgaatgcacataatgagcaactactgtatccagcactgtcctgggcactggatgattaagctacagccccttccctcgaggatgttaaagtcccagcactttgggaggaggagaaggaggaggaggaggaggagactcttacataatgattccagcccaatcttataatatctataataggggatttggggagcacagaagaggaagaaaataacttagcctgacacgtcaggaaagtcttccagaggtagtaatttatgggctgaaccttaaaatataatttgttttttgccaaactgagaaaaatattaggcagaggaaaaaacatgtattaatacaaaggcaggaaagagaatcaatatttagggaactgcaagtattgatattctgtgccatcatttggaatggaaagtatgtttcagatccaattgtgagagacagaaagttgttactttattgtgtatgtttcaaggctttattattccaacaatttttcttgtatcatcagatggattttatcacaaggcagtaaagatgttatagtcacctttggtgaagcaaataataacttatttatagtttctggctggctgccttctgaaaaactgtttcatttgacttataataaaagacacatccataattagcctgttcatatagacacatgaaacaaaagctatagctaggaggggaataatgccatttccccaggctcttttcccttcattggcttacttggcattcaggataatcctctgaggatgggaaacagggttatctagattcgagcccagcatgtagctcctggaagtgcttgtgggctcaacaaatacacggatgttttcctcattttccagctgatgccacacatatttcctggtactcttgtgtccctgggtctccatcccctcatgcttttgggtgggaataatttttttgtttgttttttgagacagagttttgctcttgttgccccagctcgagtgtaatggcgtgatctcagctcactgcaacctccgcctcctgggttcaagtgattctcctgcctcagcctcccgagtagctgagattacaggcacccgtcaccatgcccggctaatttttgtattttagtagagacggggtttcaccatgttggtcaggctggtctcgaactcctgacctcaggtgatccacccaccttggccttccaaagtgctgagattacaggcatgagccaccgcgcccagccgggaataatctttacttgctatccttcagagtcattacttgttggagctccttcacccaagcttctttcagattctcttgcctttttaatgtttttctcctctttaaaaaaatcactccatgcataaaacttagaaaacaggaaagcacagaaaagaagtgcctcgtgatactataaccaaaggatactcagtcaattcttttttatttaaaaaaaaaagttatgacatcatttcagactttcagaaacattttcgagaataggacaatttctttaaatatttatttatttacttatttattttagagatgagatctcactctgtggcccagcctggagtacagtggcatgatcatgtctcactacagcctcttactcccgggctcaagcgatcctcctgcctcagcctcccaagtagctaggaccatgggtgcacaccagcatgcacagctaatgtttaacttttttgtagagatggggtcttgatatgtggcccaggctggtctcaaactcttggcttcaagccatcctttcacctcagcctcttaaagcactgggattacaggcatgagccaccacacccagccaataaagaattcttgaatgctcctcacccaaaactgttaacatctaactatacttactttatctctctctcttctctctgtctctgtctgtctctctctttatatatataggcatatatgtatatttcttttttttttttaagacagagtcttgctctgtcacccaggctggagggcagttgtgcaatcttggctcagtgcagcctctgcctcccaggtccgagtgattctcctgccttagcctcctgagtagctgggattacaggtgtgcaccaccacgactggctaatttttgtatttttagtagagacgaggtttcatcatattggccaagctggtctcgaactcctgacctcaagtgatcctcccgcctaggcctcccaaagtgctgggattttaggcgcgaaccaccacgcctggccatatatgtatatttctgaacccatttaagaataatttgctagccaattgtcacctgggccaaaaaaaaaaaaaaaagaataagttgcagatattatgcacccttatgtcagcctcagtccttcagtgtgtatttcctaaaaatcacatattctcctacatattaatttttatatatgcctttctagattttttctatgcacacatgatttatttatatttaaataagatcatgcattgttttatttatatttatttatagtgccttgcttttttggggggtagcaatacatattgtatataatctcctgccaataaatattctacaacatgattcttcatcaggctttgacagcagacacggtggatttctgggtggcacaacattttcaaaataccactctgcatcacggaatcagccgtgctggccgggcgcggtggctcacgcctgtaatcccacaactttgggaggctgaggcgggcggatcatgaggtcaggagatcgagaccatcctgggtaacatagtgaaaccctgtctctactaaaaaaaaaaaaaaaaatacaaaaaattttacaaaaattagctaggcatggtggcgtgtgcctgtaatcccagctattcgggaggctgaggcaggagaatcacttgaaccccggaggcggaggttgcagtgagctgagattgtgtcactgcactccagcctggcgacaaagctggactccgtctcaaaaaataaaaaagaattaaccatgctgtgcttttccaggtctagtccaatatcagtggaaagcactgaataaatgagtaaagaggcagggcaatggaaaactctgaattcaaatttaatctttattctgtggccagtagaaatccaatgaaatgtttctagcaggaggggacaccaataaaagctgctctctggagatgaatttgacagtgtctgcaggatggggtgaaggaaaaagaactcagagcatgagtccaggagtcactggggtcaaatgatccctcgtgttcaaggcacatctctgcccaggtagaacagagcctttcccagcataacgcatctttttctttcccgtgtctttcagaactggttaaagtcctatggctatctgcttccctatgactcacgggcatctgcgctgcactcagcgaaggccttgcagtcggcagtctccactatgcagcagttttacgggatcccggtcaccggtgtgttggatcagacaacgatcgagtaagatttccataggacattgtgcctttgaactttctggacttacatttgggttcacatttgtcatggcctgtgtacaccccatgcccatcctcccttcctatcttttattcctgcagtgccatcctgggaaagaatatctcgatgtgagttgggggtgtgctgggatgggagtccagccctcccattaacattccatgtgaccttggagacaagttgcttaacccttctggacctcagtttccttatcagtacagtgaggggttgggttatagatggggtcttaaatcccctctggctcgaataatttatctatgggtcaccctctggagttccctgcaacgtgcatgtctcacagaatacagaaaacgcttgaatgataatgagttggctccactttttccatttaccaaacatgtgctgggtgcctgcatgtgcctgtcatccggccctccagaggctcaccatttagtgacaaatacagtcatctagccacaccagtctagagctcagaaggaaacaatgagttttggggagacacttaggaggtagtaacacttaggaggtagaaaaaagccatgaggatggtcccaatcactcaaggagaatgtaaagattcacgggcagggtgctggggatggaaccccacaaagccagccgagaaggggcagccggagggcaagaagcctgacgtgatgatgtgatgcaatgtcatgatgccacatggtgtggggtggtcagtggggccagccactccagagccctccaacaggagcatggctgaaagttgtctgctgggtttagtgacaaagagcttgttgttaacctcagcagaatggtggagatgaagtcagactgaagtggggagaagcggaggtgaggagaagaggtggcaagtggagggaagacattcaagaagcttgacagggaggtggggagaaatgggtagcagctagaggatgaagttttgtttgtctaagataggagagagttgaacagccttaaacttgcttaagaaagctatgagagttgtttaagaaaagccattcacatcattaaagcatggaaaagaacaggagtgagtttcctaaggaggtgggaagggaggggaacctgaggcaggtggaagatgctagcagggctgggtgaggatccaagggagttggtggggggaggaacaggaaatgcacccagttgtggatcaaggatcaatttgacgtaagtcactcctggacagaatcatctctctgggtctcagtgtgttcatttgcaaaggagggtgttggattatggctctaaattctagattcccccccccttttttttttttttgatgagatgaagtctcgatctgtcacccaggctggagggcagtggcgtgatctcggttcactgcaaccactgcctccagggttcaagcgattctcctgcctcagcctcccaagtagctaagattacaggcatgtaccaccatgctggctaattttttttgtatttttagtagagatggggtttcaccatgttggccaggctggtctcgaactcctgacctcaggtgatcggcccacctcggcctcccagagtgctaggattacaggcgtgagccaccgtgcccagcctagattccattattttaagcatctaagcttttaaaacttggcaagtctggggttttaggatcctaaaatcctgtgtgaacatttcccattcctaggattctctgattatgagtgtgaacttcttctcctgtgctgttgtgaatacagtggactccttggccccgtggtctccagagtgggctggttaaagagagcccagccgcctttcaaagcggaggttattttgagggctttgcacaggcctcatggcagtgcatcctggggcagaagcactggtgtctctgctgcggcaccacctggccttgggttttactctgttccaaaaagccccaggcctgttggatggcgctcagagagtggcaggtggatggtgaaaggaggaggcagcgggaatgatccgagggaaaaggatggcatttcccacttgcagttctgcccacacctccttgtagaaggcgggggagttgtggtctggaagcaggggaaggaggaagccagttgcacttattaatccaagacctgagatggggagtgttcagggtagaatttagagccccaagatgcagctccagctctgtgaccttgggcaatggctgcctttctctgagcctgtttcctcccctaggtgcctttgggtctaactcagtcagaggtggttcttggttcccttcccagggactgttaattaaaggaagctagattagccatttaaagtcctatgtttgagtgtcgccttgggaaatgtcacacatttattcattcactcattcatttggtcaacaacatagttcctctagctcagctttgtgctaagcactgacaggaaaaaataaaagctccaggctttgttaaattgcattaatgaatagttcattttttcattcaactaagttccagtcctgccttgctgatttctgtgttttgcaaggtactggatttatctgtggattgtttccctcatctgtgaaatgggaataataatttcttttttttttttttgagacggagtctcgctctgtcgcccaggttggagtgcagtggcgggatctcggctcactgcaagctccacctcctgggttcaagccattctcctgcctcagcctcccaagtagctgggactacaggggcccgccaccacgcccggctaattttttttttttattttttagtacagacggggtttcaccatgttagccaggatggtctcgatctcctgacctcgtgatccgcccgcctcggcctcccaaagtgctgggattacaggtgtgagccaccgtgcctggcccgggaataataatttctgttacctcacagtgttgttttgagaatcaaacttttttattttatttatttatttatctatttattgagacaaggtctgactcccctcacccaagtgtactggtgtgatcttggctcactgtagcctcaactttccaagctcaggtgatcctcccacctcagcctccctagtagctgggactacaggcacatgccaccatgcctggctaattttttgtatctttagtagagatagggttttgccatgttgcccaggctggtcacaatcttctaggctcaagcaatctcctgcctcagcttcccaaagtgctaggattataggtgttagctactgcacctggccaagaattaaacattttaaaagaatgtgctgggcgcagtggctcatgtctgtagtcccagcactttgggaggccaaggtgggcagatcacctgaggctaggagttcaagaccagcttggccaacatagtgaaaccctgtctgtactaaaagtacaaaaattagccaagcgtggtggtgcgcgcctgtaatcccagctactactcaggaggttgaggcaggagaattgcttgaacttgggaggcagaggttgcagtgagctgagatggcaccactacactccagcctgggcaacagagcgagactctgtctcaaaaaaaaaaaaagaaagaaagaaagagaaatacctgaaactgggtaatttataaagaaaagaggtttagttggctcagggttccacaggctttacaggaagcatggctggggacgcctcaggaaactttcaatcgtagtagaaggcaaaggggaaacaagcacatcatcatatggcaggagcagggggaagagtgagaagggggaggtgctccacaccattaaacaaccagatctcatgagaactcactcactatcagcagaacagcaagggggaagtctgcctgcatggcccaatcacctcccaccaggccccgcctccaacagagacacaaatcaaaacatatcacctggtaacaaacagatatcaggatttacgtaatttcaggcactgggctaccttcttttgaggatacaatgatgaataggacatagttcctgtcctcaatttaccatttattagaggaaataaaccaataaattttaaatcacaacacaatataataagtgctgcagagaattatgttccacatcccacagttgttaagccacttcttttttttttttttttcctgaaacggcatttcactcttcttgcccaggctggagcacaatggcacaatcttggttcactgcaacctccgcctcacgggttcaagcaagtcccctgcctcggcctgctgagtagctgggattacaagtgtgaaccactgcagctggctaatttttttttttgtatttttagtacagatggggtttcaccgtgttggccaggctggtctcgaactcctgacctcagataatccacccgcctcagcctcccaaagtgctgggattacaggcgtgagccaccgtgcccagctgaagagtttgaattttattctcagtgtttggggaagtcgctggaggcttttaaccagggcatcctgtaatctcattgcatttacagagcattttcacatgtacttcctccttgaagacgcacctccacctaagaccaagaactagagttctcatgttgcagaggaggaaactgaggttcatattggttcagccacttgcctgggggtcctatgactagtggtggagctggagcttatcaagcccatatattctgattctcagtctttatacagctatttcctcatctatgattgtgagtgcatgaattaatgaatcaatcaatcatgttcttgttggggtccatccaagccagggtcccagagtgtagcttgaggatgcacattgctttccagactggagctggggaataggcagtcccttcctaaagtgttcagtgaccacagtgcatatgcgtgtgtgtgtgtcctctctctgcccaggtggatgaagaaaccccgatgtggtgtccctgatcacccccacttaagccgtaggcggagaaacaagcgctatgccctgactggacagaagtggaggcaaaaacacatcacctacaggtgcttcgactctccctcttcctccctgcctttggctccaccctcactctgtttttcctggcctgagtttcaaaggctcacaatgtaggggggcctggggatcaggcttacaacataggccaagagccaggcatgtgggcattggcactaggtgctgagagcccataaccttgtcctccttgtggcttccacaggatgctgtgactccaacctcaggtttatttggtcctctgggggctcttagttgtcttctgtttagatgcctatagtttttaggttacaggaagtggggtatgaatggtttggtaactttcagctgtgaaaaagaatcgtggcttgcagtgagctatatcatgccactgcactccagcctgcgtgacagagtgagactctgtctccaaaacaaaacaaatgaaacaaaaaccacaaaacaaaacaaacaaaaccatggcttaattcagtctccttatcactgcctgccaaaccccattccctctgatctggatcctcccaccccaaaatccacctgatggacttcacctgagattcccaacgcagagttccagttgtttcttaaggagtataaagaactgggacctgaatcataatagtgtcatctttgactgtctggaggaaccaagggcagagcaggatccatctccaagtcagatcagtggcccaagaactagatgatggagcccatcacagcagactgaagcaccggagtgaggctggggcaagggccaggcattgagcaggctcaggtgggggtggggcaaggggcaggcactggacaggctcaggtggggctggggcaagggccaggcatgggcaggctcaggtggggctggggcaagggccaggcatgggcaggctcaggtggggctggggcaagggcccggcatgggcaggctcaggtggggctggggcaagggccaggcatgggcaggctcaggtggggctggggcaagggccaggcatgggcaggctcaggtggggctggggcaagggccaggcatgggcaggctcaggtggggctggggcaagggccaggcatgggcaggctcaggtggggctggggcaagggccaggcatgggcaggctcgggtgggtgctggctggcacttctcaaggctctgctgtcatctcaggtggatccctttggtgcagaggcaagatctaagacagagatcctcaagagttgaactaagggctcccctgctgacaagcactccctacagaacgggactttttttttttttttttttttttcagaaatctgacaagagaaggaaagttagggttgaactaagggctcttctgctgataagctgtcccttcagaacgggattttttttttccagaaatctgacaagagaaggaaacttaagaatctaggttagaaactgaatagactcttgggtctcttgaaggggtagagtggatcaagagaaagaagcactgggttctaacccaactctgagtaacttctatcactagacttctctgggcttcagtttccttacgtgtggagtaggtagaataatccatgccccagagggtcacagggcagggaacccacaggtagtaacgttgttttgtgaagaaccaatgcaatatgaacacagcgacgctaaacagctaaacctataatggattaaatcagataccggccagcttctaggcagacaagccaaagattggtaccaaagattttttaaagagacttttcacttaaactcctctctattatttgaatatttttataacttttataaatgaacatatttcgtattagggaaaaaaacttaaaattcagaaaatgctatctaccaatttcctttgggttttttttttttttttttgagacagagtctcactcttgttacccaggctggagtgcagtggtgcaatcttggctcactgcaacctctgcctccgggttcaagcaattatcctgcttcagcctcccgagtagctgggattacagactcacaccaccacgcctggctaatttttgtacttttagtagagacagggtttcaccatgttggtcaggctggtctcgaactcctgacctcatgtggtccgccagcctcggcctcccaaagtgctgggattacaggcgtgaaccgctgcgcccagccccaatttacttttctcaacaaactagagtggaatcctttattcgacacagctttgctggagatcaaatggaaaacactgagtaaagcaaagccatctgactgaggcagggtggggatccagagctctgttactcagcctcttcttcaatccctgaggcagctaagcagaattctagggttcaaaatcagatcactgagccacattgtctcaggtatctattttagctctgctagtctctgactctctgatcttgcctaatgatcctcccctctctcaccagcattcacaactataccccaaaagtgggtgagctagacacgcggaaagctattcgccaggctttcgatgtgtggcagaaggtgaccccactgacctttgaagaggtgccataccatgagatcaaaagtgaccggaaggaggcagacatcatgatcttttttgcttctggtttccatggcgacagctccccatttgatggagaagggggattcctggcccatgcctacttccctggcccagggattggaggagacacccactttgactccgatgagccatggacgctaggaaatgccaaccatgacggtaaggccatgaggggacaggggtcagtcttgggctgctcagttgttgggaaagaacttggaggacatcctagatgagtttcctgctttctagagcctcttgtccaagaactaagaccgtaagagggtgggaactgtgatttctgataatattcaacgttcaatccaccagggccagggccatggagatgagtcagatcacttagaagatagtccggttggcaggagaaaagtaaggttaggccagtaagaagataaagtaatggaccagaggctgaagaaaaagtttaaaaggggccaggcacaatggctcacgcctgtaatcccagtactttgggaggccaaggcaggtggatcacctgaggtcaggagttcaagaccagcctggccaacatggtgaaaccctgtctccactaaaaatacaaaaattatctgggcgtggtggcgggtgcctgtaatcccagctactcaggaggctgaggcatgagaatcgcttgaacccagaaggcagaggttgcagtgagccgagatcgcaccattgtactccagcccaggcgacaagagtgaaactccatctcaaaaaaaaaaaaagttaaaaggcattaaagctgaaagaggggtctgaaagtagtaggctctggcctgaatgatgagggctccaaaagccatcttatgaatgacacgactggctctctcctttgtcaccctcacaggtgagtagcaggccctgaaattattctggcatccttggataatttaccctgcaccactatggttcaatgaatatttatggaggcagagtcaataccgtgcagcaatagtaatgataccctgcaggttgccaaaaaattcatcatcaatatttactcacaaggcacatgcttagtatgtaggcaagtgtacattattacacccatttttaagatgaagagttggggctcaactggcatagctgaaaggtgacaatgcaggtatcaagccctggttcaactactggctatgtgataccctcggtctcctcgtctgcaaagtgaggggctggattaggtgatcgctaagggcccttccaactctaatgaacatgatacaaagtcttgcaaagaccagggggagctgaatgtttgaaaaaaatggcatgatctctgtcccctggcagtccagagtcagtctagcaggggagttaggtgtgcacgtaagtaaccctgtcatagacagactctacccaaggctgtagcagaggcacaaagaaatatgtaggagtttggaggaaagagggacagaggagtgtggcttttggattataagagatgataattagtgggtatgctggtgttctgaggcccgtgccaagtgcttgccacccattatgtgtggaaactattatatctattaatacattataatgcataattaaatttatgtattaagcaatatataatgttaaattattattataggtaaatattgctatcttcattttacagataggtaaactgagatatagagaaacattaagtcacctacctaaggtcccacagttggtgaatggtgaaataaggctttgaatctgggcattatggccctggagcccatgctgtcagccatcatgctaagcttccatggttctcaaactgtagggcacagcagaatcacctgggaaccatttttaagaattcagattccaggccaggcacggtggatcacacctgtaatcccagcactttgggaggccgaggcaggtggatcacctgaggtcgggagttcaagaccagcctggccaacatggtgaaacccatctctacgaaaaacacaaaaattagccaggcatgttggcaggtgcctgtaatcctagctactctggaggctgaggcaggagaatcccttgaacccgggaggcggaggttacagtgagccgagatcatgccactgcactccagcctgggcaacagagattccgtctcaaaaaaaaaaaaaaaaaaaaaaaaaagactgcagattccaggaccctaacctcttgtcattctgattctctgggtccggggtagggcctgggaatctgcaagtggtctaatacattcctggggccttctgatgcaggtgttccatcaccatgagaaacgctatcttaatacctagagttttcctacctggcctgatcataagaaccaatgggggttcttgttataaacggggattcccaggcccttcccacagaaatcctgactcttgagctcaaacaagcttgggaaacaccgagcatccttttttcctgccctgcggctgctccaggctgagagcagactctcaaagctggtttggtgtctatagttggggccatgtttggtgtctatagttggggatcacctccttgagaacactttatatcatcgcatggattagggattggcagctctggggttatctgtcaaaggctggaccaggaggtggtttggccaaggctcagcctaggcaaagtcatgaacctgttaaattgttctttgtcctcttctttcttcagatttttgtcctctttcctattgaactccgtttcctttgccctggtatctctcccgtatgtcctgcatgtattcctggctgagtacctgttctttatctcattcttatttttggatcggtgtcaacgaatggctgtctgtgctaacagataagatgtgaggagaagagaactaatatttttgaggccctgttatgtgccaggcactgttagctgatagggttttagttatattcctgatagaggcaaatgaatgtccaaagagttgtccagaggcaacgggaagacactcccactcctctgccctccccttctgcccagcactgggggtgtgcacttcccacacctgctccttgcttttgcagaacttgttggacccagcccccaaatcccaagagccggtggtatgtgtgggaaggaccggggacctgtggatgggcaccatcccagcacctctcccatctgtccaaccctaaccttcatgaaagactgccaattctgatagaaattccaagattgctaatgttttctttggataagaatcaggactttgctctgctctggaaaaccaagcaggaactgtccagatgcagctcaggaccacagcaatcgactcctgaactggaatgcagtgaaggcaggttttgggtgagaggcaaggaaccaaaatttattgagcatccatatattatctcgtttaatttccacatagactcagcaaaggggtggagtttcctgggaactttttgaacttattagcttacttcttttttctaaactctcattatggaaaatttcaaactcacaaaagtaggaagaatgcttctatgatctcccagatacccaccacctgcctcagcaattatcaacgttgtggcattcctatttatctacctttttttggctgatgtattttaaagaaaatctcaggcattctaacatttcacctttaaatactttagtatatacctctaacagataaaggctaatttttaacataagcacacaatcattatcaagcccaacaaaattaacaataattttttaaaatctaatacccagttcgagttcactttcccaaagtaccttggaaatgtcttttacagttgtttgcttgaatcaggatccaaacaagatccacacacacatggctgacatgtctcttaaagccctttttatttaaaacacccccgtcctacacacacgtttccctccatatatttgttgaagaaactgggtcaggtgtcccgagtataatcatttggcgtgactagaatcaagtttacttttaatacgtctctcttgcccataattcctgaatgttgttcattagatttacaggctgactagattcaagttcaatttttttggcaagaatacttcctaggtggtgctggtacttcctattcaccatattagcaaatacatatgatgcagactgtcccacttttagtgatgttgaggtcgagcatttgcttcaggttgtgtcagcctgacccaaccattatacaattcacctggagaacttaaaaaaaaaaaacaacaaaaaagattgcctacgtcccaaaccaaacctcctgaatcagaatatcttccccacctcctccatgtgtttaaaaggctccccgggccaggtgcgatgggagcactggagtaatcccagcactttgggaggccgagggggggcagatcacctgaggtcaggagttcgagaccagcctggccaacatggcaaaaccccgtctctactaaaaatacaaaaattagccgggtgtggtggcacatgcctgtaatcccagctactcgggaggctgaggcaggagaatggcttgaacccgggaggcggaggttcaagtgagccgagattgcaccactacactccaacctgggtgacagagtgagatcctgtctcaaaaataaaaaagaaagaaaatactttttaaaaaaataggaaattcacccctttggaaagtggcagagccaggtgtgaccccaggactccgcatttttaagtcaccacaggtggttctgctgcaggtggtccgagtatttcccttggtaaaatacggtgcttttggcgctgttccattccgggggctgtcacctggttcttcaacacaaagcttgtcctcaaggaacccacagtcctggggcagcgagcatgtgcactagtggcaatcacgtggggaggaagcggtcagtgccataaaggcagttcagggaaactgctgggagggcacagcagaaggagcactcactgccagctgggaagtcatggaaggcttcctggaagacaggcatggagctgaactttgaaggaatcaggttattccaggggaaggggcagcactggcagaagaacagaggcaaagggaaatgctatcacctttcgtggggctgggggagttaatgagatgggaacgaccaaatatggagatcctaaaagaaagaaatgaggcagagacaaggtccacttgagtagccgagtagactgctggggacttgctcggaggcccagggacttacaggaacacaccctatcaggggtgctggtgctcacacacagctcaacaggaccctgctaatgaagggtaatacttctgtaccaggagctggtatcagcgcattacacaccctgccccatgaatcttcacccacatccctatgacgaaggtgccattgttccttctatcttccagaggaagaatttaaaatgtcacactgctaggacatggcagagctgggattcaaaaccaggcagtctggctcccagagactgcattcctgaccactctgcttccctgccgctcaccctcttgaagagtgaagaccctagcagcctcctgcccatggagcatggggtcctcatagcaggcctctcctcctcatacctctgccttcacctcacaagctcagggagtcctcctgcccctgccctgctccctctgtctccccctcagggctctcttgggtttctgtgcagcaggatactggctccctcgctcttcccttccttttggttcctggacccaaaccacaggcctctttcctttaaggggtcactcctgttctctgcagacccagaacaggggttaaaagagcaagagacaaggctgcggacaaaggttttgagtctcccacagtgctcagagccgtgttccctggttcccagctgagctccctgtggacagcccctggggaagagcctgctcaggagacagaggccctgaacagcttgtcccaggtcatagaatagcccaggagcacagccaggactggaccccaggaagcagagctgccttccgctggctctaccagtttgtttgggatggagctcagcgatgagctcacccttccctgctgccagaggggccaggacctgagtaaggagctgggggcggcctggccctctcatgccagcagaaggccagccccaggcttttggccaaccttgcactgatcttgcccatcccccttcctttccgttgctcaaaggtggcttcacagaagacactggcggtgtcagtagtgtgggaggcatgtactgcccgtggcctgggtctgccccatggggttcttctctcttccagagacctaagccaggaaggccaaacaatccccacccccatgtgtccctaggccagtgacgctggggccagagtgggcagtaggactctagaccacctcctaggttcctggcagcctccctggacttacaggtggcaggaatgggccgagccatgccttagggccagaagataagaggcagggctcaaggggctacaaatgccagaggtcaaggcaagcaagggtctgacactgggcagacaggagtcaggactggtgatccacagcctacctgactccctaccccctgcattttctccccaaagctgcggttacttcatccccctaagttcaggcctccttgtcctgtcctaggcacaatacagaagcccaggggagttggctttcagaggatctggttgctggcgctccactggcctcgtgcttcctttctggtcaatgggcttcctccagtaaccaagcttctatcttacataggattacaacagctgccattctgtgtcataccacgcacttcacgtgtatcttattcaacctcacacaacccggtgaggtaggtctgatgcccccagtttacaagtgaggacattgaggcttaggggtagccctgctggccatattcacaaactggcagggggaatgaaggtaatctgtcctactcaggagcccaagctcgtaaccaccgtgccatggagctgcctcagttccaccctcaggatcctgtgtcccacttccaggacctggagtgtgttttcacctacacttgaatccctgcctcaatcttagccaacagttccctgcttccacaaccaaggtcctgcagagagctgcccacgcccgggccccacctgccctgcccggggtctcctgaagctgactgccagtttgccaggacttgctctctttgtccccactccctccctccacctcagggcatcctttttttttttttttttttttttgagatggagtctcactctgttgcccaagctggagtgcagtggcgcgatcttggctcactgcaacctccacctcccaggatcaagcgattctcctgcctctacctccggagtagctggtactataggcgcaggccaccatatctggctaatttttggtatttttagtagagatggggtttcaccatgttggccaagctggtctcgaactcctgacctcaagtgatccaccccgatcagcctcccaaagtgctgggattacaggcgtgagccaccacgcccagccagctcagggccttttcatctcttgtaggggtgggttgcccctccacacctgtgggtgtttctcgtaaggtggaatgagagacttaggaaagaaaaagacacagagacaaagtatagagaaagaaataaggggacccagggaaccagcgctcaccatatggaggatcccgccagcctctgagttcccttagtatttattcatcatttgtgggtgtttctcgaagagggggatgtgtcagggtcacaagacaattgtggggagagggtcagcagacaaacacgtgaacaaaggtctttgcatcatagagaatgtaaaggattaagtgctgtgcttttagatatgcatacacataaacatctcaatgctttacaaaaccgtattgctgcccgcaggtcccacctccagccctaaggcggtttttccctatctcagtagatggagcatacaaccgggttttataccgagacattccattgcccagggacgggcaggagacagatgccttcctcttgtctcaactgcaagaggcattccttcctcttttactaatcctcctcagcacagaccctttacgggtgtcgggctgggggacagtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccttcaagcatctgtttaacaaagcacatcttgcaccgcccttaatccatttaactctgagttgacacagcacatgtttcagagagcacagggttgggggtaaggttatagattaacagaatctcaaggcagaagaatttttcttagtacataacaaaatggagtctcctatgtctacttctttctgcacagacacagtaacaatctgatctctcttgcttttccccacaatctctcgcctggaccccagcatccaaacagatccccctgccccaggtcttgttccctctaatcctccctcaactgcagccagagtgatttaattgtatcaccacccccactcctacttaaaccccccactagccaagaagctgatccaaattcctttgtatggcattaagcgccctgctttccagcctggctgacctcatctctctccggccctcccctcctgctttgttccagagccaggtggaatgaaactgcctgtctctggactgtgtttattgcattccatccgccaggaatgccacccccacccttcctctcctgccccctgaatccgttctcctgactaacttctgatccttcaagactgagcttcaacttcacctttgtgaagctttccctgaacatcttcctccaggtttaaatgacccctctctcctcagaatccctgctcgaccctcccagacattcttaaagcacccagagccctctgcctcacttgtcactctctctctccttgtccctgctctgcagagaggcttgggaggcaggggttgtgcctgatttctctgtatgtccctggtgtccagcacggggcctggcacagggcccgtgctcggtgtttgctgaggtaatgggttggctgaccgactcatatctaagcaggtgccctgggcacctccccacactcctctccacagggaacgacctcttcctggtggctgtgcatgagctgggccacgcgctgggactggagcactccagcgaccccagcgccatcatggcgcccttctaccagtacatggagacgcacaacttcaagctgccccaggacgatctccagggcatccagaagatctatggtgtgtggcagggagaggggggactgctccttcctcggggctgggctgtgactgcctacctgtcatggggcaggggacgagggagggggacgttgctatcatcagcactgctgctgtttctctgtgtgtgacctttacagacttccaatggctttgcctggccagagggcaaggcttcccctggcacacctgggaaacctaggggagggtctgagctgtaactgagagggacaaaagtgaggtgagggccacccattccctctcctttacccctccccttccacactcttccccgtcccttcatgcttctctccctccctcccacaccagatggtgactgagtgctcccatagattccacctctagccaggcaggttcacacatctgcaggagtaacggtgatacagcgtgatggggactataaccagagctttgttctttaaaaagaaaaaacgagggccaggcgtggtggctcttgcctgaaatcccagcactttgggaggctgaggcaggcaggtcacttgaggtcaggagtttgagaccagtctggccaacatggtgaaaccccatctctaccaaaaatattaaaacaaacaaacaaaaaaattagccaggtgtggtggtgggcaagtgaaatctcagctacttgggaggctgaggcaggagaatcacttgaacccaggaggcagaggttgcagtgagctgagatcgcaccactgcactccagcctgggcaacagggcgagactccgtctcaaaaaaaaaaaaaaaaaaaaaaaaaaaaagaaagaaaaggtgaaagatgagaagctactgctatctaggtaagatatgaaaggcctcctacacacctctctcccagttctgttcacactggtatgtgaggttcttgttctggtcaagtcaggtgagctagggagaccagtttacttgagcaaatgcttgtcaagacagcacaggcacccacagcccacaggctacggagcacagaaggagggctccctctggaggagatgacccagccagagccctggaggacaggcaggacctccacaagtaaagcagcagagaccaggtgggggctgtgggtcccagaagctattccaaaggtagaacaacaggatctgctgacagatcagacatggggtgagaggaaggagggagggtcaaggatgcccccagggtttccagcttttgtaattgtgaagcaatagggtccaccagtctgcagctcaaaattctaggctggaggccgaggcgggcgattacctgaggtcaggagttcaagtctagcctggccaacatggcaaaaccctgtctctactaaaaatacaaaaaattagcctggcatggtggtgcacgcctataatcccagctacttgggaggctgaggcaggagaatcacttgaacccgggaggcggaggttgcagtgagctgagatcacaccactgcactccagcctaggcgacagagtgagactccgtctcaaaaaaaaaaaaaatctaggctggaatacttatttgggatctttgttgttcaatacagtaaccactagtcatacactagtatgtattaaataaactactattaaataaactagtattaaatttcatagtaatgaaatttaaatttatatttattaggccgggcgcggtggctcaaacctgtaatcctagcgctttgggaggccgaggtgggaggattgcttgaggccaggagttcaagaccagcctgggcaacaaagtgagacccctgtctctacccccccaaaaatatattaaaattatcatttcagttatagttctttagtgggtctcagtcacactaagaactagtcattcatcttaagacctcagtagccatatgtggctgtggctaggggctactgtagtgaacgatgcagatatggaccatttccatcatcacagaacactctactggacagctctgatgcaggtctgtaaagccatgagcctggatgagaccacctagagcagtgattctcaacttggctgccctttggaattaccttgggattctaataaaaaaacacagacacccagccctcagctctagagatttggttttattaatagttgggtattgggcgtggtggctcacgcctgtaatcccagcactttgggaggccaaggtgggtggatcacttgaggtcaggagttcaagaccagcctggtcaacatggtgaaaccccatctctgctaaaaaaaaaaaaaaaaaaaaaaaaaaatcacctgggtgtggtggtacgtgcctgtagtcccagctacttgggaggatgaggcaggagaatcacttgaacctgggaggcagaggttgcagtgagcttagatcacgccactgcactccagcatgggggacggagcgagactccttctcaaaaaaaaaaaaaaaaaaaaaaaagttggagagctggcctggtgcttcctgaacatccagtttgaaaagctcccaaaggtgatcctaatatgcagcccaagtgaagaagcactgacctaaggatgaaaatgtagagacggaagagaagaggacccaagggcacgccagcctctagagtagggcagatgaggacacgcagccagcaaaggagactgagaaagaacagcccatgaggcaggaggacaaccaagagagtgtttccaggaaagtgtttctatgaatcttgctgctcaaaatgtagtcttcagaccagcagcatcagcatcacctgagagtgtgaaggaatgcaaactctcaggccccaccccaggccctctgagccctcatctgcattttagcaacatccccagatgatgcatgtgcttattaaagtctgagtcaagtaaccattggatgatcttggcagagcagttggagtgggtgacgggtagaagctgcactggggtgggaaagagaataaatgaagggggtgaggaagtggggccagtgcgtgtgaagggggcaaagagggtatggcctaaggaagagcgctgaccctaaggaaggacatgattgctctgtaacaggagagagaaaagagaagataccagattcggggatggaaagatgagagtcccattctaatggctattttcatccattttctcaaagactgggggagttaaactggggagagggaacaggaggctgaactgggacagacttgtctcagagctgcctgggtgatgctgagactggcaatgggaggcgggaaacggctgccccctctctaagatgcagctcctctctccaggacccccagccgagcctctggagcccacaaggccactccctacactccccgtccgcaggatccactcaccatcggagaggaaacacgagcgccagcccaggccccctcggccgcccctcggggaccggccatccacaccaggcaccaaacccaacatctgtgacggcaacttcaacacagtggccctcttccggggcgagatgtttgtctttaaggtagggccaatggattggcaccacccagctggcccctgacctttcctcctcctccccgacatcatggagctggggaaggctcctgatttgggattcgattacaatggggcctggacaggagctagcccagtggccagggcatggggtctcttcctagtgctgctgggtgaatcaactgttcccaagagggagggggaaagatgggtgatccctcacctcccctggggttaatgctgggagaaagtgctggaagctggcttctggtctgtgaccacccttcttgggacctcagtttctccatccgaaacctgggggagtcattcctctaacaaagagtgtgtgaagatccagtgagtacccggctctgaagatggtcaacttggagtaggggctaggtcagtggtggctgagtctgactccagaccctaccaaggcttgaggggctgctactggcagcagcccagggtatatcttgtcatctgtcctccatcagccatggactgacagggtggcagtctgcttgacgtgttgcaggttgggctctcggggagtgaactctgaggtggggtctggaatgcaggatttcgattagagagtactttcagaatcaacatttgtgagggggagaaggaagcaggacagggaagagggagaggttaagtggcaacagaggcccatggcagcctcagccacccccgcagggagctctggggctacggtggcctgtcactcagcctacgttgggtccaaaatatctggaacattataacccctacctcattcaatcactggatgaggaagggcatccagtgactgaggagagctctctgaagcagggaacatccccaaaggggctgacagttgaaaactgcctgctggccacactgctggccactggggcaacaagcccttctctgaaggggatctgggcagggtggctccatcacacaggatggtgaaagaggctgcctcgctccccttgtggagttctcccagcacgcactgagcactgcgcaggaatcgggcagcgtgagtcagccccagtctggcttctcactgagtggctctaggcaagtcacctggcctttcttaagactccgtatatctcagatcaacttaacagagacatgaaagtcaaaataaggtcaaaaacctggatgtgaaagtgctttgtaaaacaccttttaaaatactagcttttgtaccatcttttacaaatcatgcttcttcttctgcactcattctactttgatccaactgaaccgttcataggcaggtccgggttttatcatccccatttacacataagaaaactgaggcctggaggctgggcgcagtggctcacgccttgcaatcccaacactttgggaggccaaggagggcggatcataaggtcaggagatcaagaccatcctggctaacatggtgaaaccccatctctactaaaaatataaaaaattagccgggtgtggtggcgggcgcctgtagtcccagctactcaggaggctgaggcaggagaatagcatgaacctgggaggcggagcttgcagtgagccgagattgcgccactgcactccagcctgggtgacagagcgagactccatctaaaaaaaaaaaaaaagaaagaaaactgaggcctggaggctacaggccttgcctagactgcttgtgtaccagcccaagactgaggcaccagttacaagaggcgtttttactggactcggactatttagctgccatttactcaacatggactgtgtgccccgtactggtctgggcattttgcctagaatctctcatctgattctccattattacctgcacttgcaggtgaggcctaggtcatgcagctataaatggaggaatgtgaattcatgcccaggtctcgagggaattcccatgacttggcttccatgatcctggccctgctggatggagccagcctcatggagggcgctcggcccaggctcagtgaccaccccagcctcccactgtcccgaggaccagtctggctgatgtcagtgacgctccactgcccccatgtggccactccaggccccaacatcatcctttccggctccctcacacctccttttccacaccaggcctgtctgctgtttgtctcattgtccacccagcagcaagagtcagcaggaggctgaattgaagacagttacaggagcatcctgtcttcctcccagggctttaaaagtcagaagcagctaatggacagtctcggtggagggctgggctgttgggacctaagccccacagctgcaatcactgggttcggaggcagggcctgacacacctctctccccctctcccgcttcctcccaggatcgctggttctggcgtctgcgcaataaccgagtgcaggagggctaccccatgcagatcgagcagttctggaagggcctgcctgcccgcatcgacgcagcctatgaaagggccgatgggagatttgtcttcttcaaaggtaatgtagactgtgctgtgggacagttccctgcccaaggtcttgggacctcctttttcccatctaaactggaagaggcggggtgggaggcagatgtcctcagagggcccctctagtctaacggagacactgacctctgacaaatcaagtcagaaagtgagactgagaatctgtatgtgccgagattggtggggtgaccagcttcgtccacatgaagtagagtgtgggacaagcaattgaagaccacccagtacctcatgggaggccatcgggtcagttctgtaagaacccagagggaagaggtcactcaagctggggaggtcgggggagggtgtgggagggagctaaggtgcccaccctgtacccagcactgtgctaggttgtttcatgacagttatcttgactcgggccagacctcagatgggtgagatacagatagtgagaagcaaggaaggcattccagagggacaacggctgaataaaggagcagggctgggatgtgtacggacggccacagggcttagaaggcccacctgatggccacggaggccccgccttggaaagctgtgagaaatggcccagaaaggtcatttggaggcaaatcctgaagagccctggctgccaggccagaatgtggtcttgatccattaggccaaggctggaaattcatggaatgtttccgagcagcagagagccagagggcaggaggtgacagacatggcaggggcagggcagccatttctgaggtggttctggagcgcgccactcatgaggcccaaatgagggaggagccgtgcagctgaagggcaggggacagctgccaggagagtcagagggcctcagaagtggctgaatactcggccaggcgcagtggctcacgcccgaaatcccagcactttgggaggccaaggctggcagatcacctgaggtcaggagtttgagaccagcctgaccaacatggtgaaaccacgtctctactaaaattacaaaaactagccaagcatggtggcacgtgcctgtaatcctagctactcaggaggctgaggcaggagaatcgcttgaacccaggaagtggaggttgtggtgagctgagatcacaccattgcactccagcctgggcaacaagagccaaactccatcttaaaaaaaagaagtggctgaatactgagaggagaaggaaagagagggtcaacagtgaggctaggactccctgttggggacctgggaggcagaaggtgatgaggagggagcccctctgtggtgcagatgaggagctctggggagccagccaatgcagagctgccggtaggccgagggaggtcagggtttctggctctgctgctcaggtccagtgggagagcctcagagtcgggtgtcactggtagcaggtttggggagtggtagtgcatatgcaaagtcatgtaagtggctgagatcaccagagaggagagaggagcaagtcacatgaacaaaagagggtgggactcggagcccaggcagcagaggcaagttgtccaggatctgtgactggcctcaggcttcgtgcccttcccaactctaactgggccaaggggctgagggcatcagactgttttcacctgacaccctgaagatgggcaaacggcactgagtgactggggaagctgatcctgggctcctcttggccacaggtgacaagtattgggtgtttaaggaggtgacggtggagcctgggtacccccacagcctgggggagctgggcagctgtttgccccgtgaaggcattgacacagctctgcgctgggaacctgtgggcaagacctactttttcaaaggcgagcggtactggcgctacagcgaggagcggcgggccacggaccctggctaccctaagcccatcaccgtgtggaagggcatcccacaggctccccaaggagccttcatcagcaaggaaggatgtacgtaagggccgggccagggtgggcatggggagccggttttatgtggtcctcaccagtgcccacgggcatactcagtgcccatgggcgtccaggtttgaaaaaacacctggtggcagacaactgcctcatatctacccatgttcacgtggtccattaattcacttaccagctgccaagtcacactttttcatctgcaggaatgattcacggcagagagacgttgtcatagactgacttcattccttcagacagcatttctcaaacacttatcctcagtgtactccagggacgccttgagttacccaatctgaaaagcaatgatgggcatgcatgtttcaaagccactttttcacagggctcgagggcaagaagatggaaagaaaaccttcaaaaaaaatttttttttaaattctaagagataaggtctcactctgtcgcctaggctggaatgctgtggcatgatcatagctcactgcagcctcaacctcctagtctcaaatgatcctcctgcctcatcagcctcccgagtagttgggattataggcacatgccactgtgcctggctaatttacatttttttgtagcaacagggtttcactatgttggccaggctggtctcaaactcctggcctcaagcaatcctcccacctcagcctcccaaagccctgggattacaagtgtgagccactgcatcaagagagaaactttttatgtttcctgaactcctcctagaagccatgctggccaccagcccccacgactgccatcagacactcagcctgtctccccaccagcctaggagcttctcaggaggagctgctagcctggccagatgcagagtgggcctccaggagtgtttgttaaatagatctccattgatatggtcaaaaacacagactctagagctggactggctgggttcgtaaccaccatagtaccactcactatgaatctgagcaaatctttaataagttttctgttttctcatttataaaatgataataacagtacctacctttatataatggttttgtgaggattaaagaagacaaattatgtagcatacttagaaataatgcctagcacaccatccatgctgtatattttagctgctatcgtcatcatcattgtcatcatcatgggtttcagtttatgtggattgacaggattcattcactcactccataataatagacagcttgtgtggtgggagctggggacgtagcagtcaacaggacttgcagacgtccaagtctaggggcataaagcaagatggcaacagacgctataagggaaagactcccagcactttgggaggctgaggtgggaggatcacttgaggccaggagttcgagaccagcctgagtaacatagtgagattcatctctacaaaaaaaaaatacaaaaattagctgggcgtggtgacatgtgcctgtagtcccagctacttgggaggctgaggccagaggattgcttaagaccaggagtttgaggctgcagtgagttacaactgcaccactgtactccagcctaggcaatggagtgagaccttgtcttaaaaaaaaaaaaaaaggaaataaatgctgggagagagcaacgagctagagggggccgtgttagagatggctgggaaggagtctctgaggaggcttcactgctgagaaagccaatggccacagctgctatttgttggctgtcttgtatacctgatgctttacgcacaagatctccctttttggggagcctcagagacaggtgacatcaaggaccgagaccaatgaaagccctagccacggtgggaagccagccaatgaggacggcctaagcaagctgctttgcccactggctgggccgctcaggctgttgctcgagccctggggtggttgcccagggagtgattggcagggctgcccagcctctctcccagaaggctcccaaaggtcctgcatctgtgttgtgaagtgatgtgtgccaagccaaaaaaatccataattgcagagaggtcttgctgtcaacacaaggtgaaatcttgctccctgcctcccttggctcaagcaggagccaggctgaggcttaatggagcccacatgagcggggcaagggggacctgtgcgcacagtgtgacagagctgtgacccaggcttgcgtgcaaggggtcctgtctgggcagcacaaagtgaaccatgtcccagttctccctgaagcccctctggtttcctagcacccgtaggatgacaggcggaccactccaggtcccgggtgtccccctctgcagcttcttactccatgactcagccaagcactgcaccccaaacctccaggtgtgcccaccttgcctcccttgccacagtgcctgtgccctccttttcacactgccccagagcaggtgccggaagtgtctgggagtggtgatgctgggctgtatttctgcagattacacctatttctacaagggccgggactactggaagtttgacaaccagaaactgagcgtggagccaggctacccgcgcaacatcctgcgtgactggatgggctgcaaccagaaggaggtggagcggcggaaggagcggcggctgccccaggacgacgtggacatcatggtgaccatcaacgatgtgccgggctccgtgaacgccgtggccgtggtcatcccctgcatcctgtccctctgcatcctggtgctggtctacaccatcttccagttcaagaacaagacaggccctcagcctgtcacctactataagcggccagtccaggaatgggtgtgagcagcccagagccctctctatccacttggtctggccagccaggcccttcctcaccagggtctgaggggcagctctggccagtgctcaccagggccagcagggccctaggctggggtcgtacagctgaagtggtgggtgcattggcctaggctgagcgtggggcagggaattatgggggctgtgccccagggtgggtgtctggcacccagctgccagccttctgtcctgggcaaactactccctacttaagggaataggccaggctccatccggaggcagggaccatgccaggaggagcccctgtggtcacggcatcctgtggtgtccatgaggtaccacagctccactcctggctggaacccagcaccctctgtgggaagccagcactagctctcatcccccatccgggagataccaccagtcctggtccccttttgccaacacctgctggtcagatgtccccctacccccaccccactgtcctccaaggctacaggacccctgcttctgacacagtgagcaacaagcctgggtttccctgctggcagacggcagatccctcaggaaacctgctccacttgtcagggtctcttcggagacccaggatttagggtcacatgctgcaggcagggctgtggcccagctgggtctgacaaggacccagctgtcacatcgtgaatatttaaatgtcctgtcactactgtcccattttgcaaaggctgcttgaggctttaggtgaactagaggtgactgtcttggtgatgaggccagcatagcggccctcccccaggcgacaaggaccaaggtgctgctaaggccactctagcgcccagacaccccagtagctgagctctgctcctatggctacagagctggggcagaagctgaccccatttctggaggaagatccgagtttgtgaccgtcctccactcccctctattgtcactgtccccagctttgctccagtctgtcacttgcagcctggagctcagcctcaccagttaggtgaggcagagatggctgcagggccaacactggcagagcctgggagtccttcggaaggggaccagggcgtctgaagtgctcagtgcccccactactctgaggccgactccagctactctgaggccgactcaatctctcggctggaagcagtgttttcccagagcttggcccttgctgacctcgctcactgggcccatcttcccacactgctcttagaaggacacccctaccggtagcagccccaagctgagggggctccctttttgaccttcactggcccgcccttcactgtctccagcaggagttcctagggcttggcctgccttgctccacagtacggcggaggcagccctgcttgtcactgaggagccctagacaaggccaatgggttcatcaatgcccactggctctctgccaaagccaaaaaggtgtcaggcagtctccagcgtgctggccgggtctcggatgccacccctgctcactgagcctgcatgggccttgcccccgaccctgtggtctctgggattggggtcggcttaccctgtagcacagacagggactcctgctgccctgggagctgtctcaagcaaaatctcttgtcccagaggtgcccatgtgggtccgctgtgtcccctgtcatcatccttgttttttctcattttggccaagggcaggctccctgggacaggcagggaacaactgcggagatattagtgattcataggtttgtacagtgttttatactttgcaaagcactttattagctcacacctgtccactcacatgaaactcgtgttaggccctgggaggccgacggtaactctcaccgtgccctcagatgaagcacagagaggttgttacttgcccgggccatccagtgggctggctgggtcttgtgtccccatctgtggacccctctagggtctgagatgagatgagaagtgtctcctgtatccacctcttcctggcctcccttcccccacttcctggtccctgtccactcctcaggttggtgctctcacttcttgaaagctctaggcacccccgcctcccgccaggctccccattggctcctggcaggccagctgagaatgaacaggagatggaggcaggcagcccaggctgcagaggtgagggatgtggggccaggcccagagggctcagcctagaggcttccaatctcagattctcctgcctgtggtcatctgtttgtccatcaccccaggacagggcagacagaggggcaaagcactgggggccccagagcctagcttcccctcagcctgggggacatcacagcatttcagtgtcagtcacattttaaactgatcagcctttgtataatgttttttaaatcatttctaaataaaacagaaatacagagtgtgtcatttccctgggatgagggaacaaagatcaggttccaagagtaaccttaggacgctctgggaagagaaccgggtcctttggggtgtctgggagctgcccacccatctcctctgccagaccggcggtcagatagcctccctctacaacaggctggccctgggggcccagggttattggggttccaggaacacagcctgatgatgcctccttacgatccaggatggagagcagcccccccaggagtatggggagggtcactgtggcacgggcttctccatgacctgggacatgacctgggacacatagtcaagagcacggttatcagcaatacagatattaataaaaggcagacgaagtcaggaggtcagcaactttgcgggcttaccaggaggcctgtcctgcctctggaagccagcgacagagagggatgcccccgacccagccagccggagaaagggatggggtggtcacgaaggtctgagctgggtctgggtgtaggctgggaagcaggctggggtgtagactgcgaaggcggccctgccgggacttctttccagtccccggcgacctcttcgaattctctgctatctctggggagcctcgggtgggagggggtgtaagagacgcagggacgtggggagaggagacaaggcaggcaagaaccacaggggacggcggacagacgggcgacatcctgcggaggacgccgtcagtaccaggaagtgcaggcgatgaggaagcgcacgtcgtccagcggcccccacgggctgggctcgggctggggctggggctggggctggggctggggctggggcggatgccggggctgttccgggccctccggcgccgcaggctggggctggggctggggctgggtttgcgcaggctccggggcgccgcggccgccgcttagctgagcccccatggtctgcaagaagagaagccctttaaggtctgggtcgccgggacaccccgctagggccccgccccggctctgccctcacctctcgcagccagacccgcgggtctcccggaacccacctcggcgtcgggaggagctggcgccgtgacgccaccaccgcgtaccgacctcaccctccgtgcgttggagcggaaagaagggactcgaccctgtgcttcggggcggggctccgcgaccgtcccccgccaatcccgccccagcgcctcaaggccccgccccgcgcaaggggacggaatgcaccccaacagcctccaagacgcccaggccaggaggacgctgggaacccgctgccccgccccacgcccacccaggaaaagacctgcaacctccatccaccttagtcaaagaatgccccgaagccagatgccccagagctctcacaggggacttgcccagctcaggggaaaatcggaacggactctctgcctttcaaggccagagaagaccggcgcagaagtcgggtgaaaactgtgagaactagaccgggcgccgtggctcacgcctgtaatcccaacactttgggaggccgaggcggtgggtcgcttgagttcaggagtataaaccagcctgggcaacacagtgacttcgtttctacaaaaaaataaacgaggcgagaggatcgcttgagcccaacaggtcaaggctacagtgagccatccttgcgtcacaacactccagcctgggtgacagagggagacactgcctcaaaaagaaaaaagaaaaaaggagaactgtagtggagagtgtttcttgccccaggatgaagcctcacatcctgatggtagaggagaagggaatggcgtgtgtggaggtggtgaactgggttgggtgtgtgttgtgttcatcccaccctatcttcccagaatgctggaacaactggagagtgcagggattgtacacaggctgagggccccaaacatcacattcagaatggcccggagggaactgcactttaatggggtggcacaggacagcagaaccctcagccagcagccacagggcctgccagccagcacaacagagcaggtttttgcagtaatgatagatccaggcgataagcacaggtggaaaagggttgggtgcccagcccctcagtcccagtgagctctctgccacctccctgccagcatccggtacagattgggcggaatgtggagaaggttggccacagtccagagccaggagcccatggaacaacttggaaggtgactcaggtgaggctgaagagaaaggaaagcgcacggtcagtagctgtttcacagagcccacctcactctcaagtgaggtgcctgcctcagccctcatcccgggaccagctctgacaagctgctcaagcagctactgctctagtatcctagccctgaaaaaccacaaagatgaggattagcagatgctcaagaaatattttttgaatatgctggctcttatctgctcagcagtgtacagatatgctctcacactcgagaagctaccagaacaaactggtaggctcccattctagatgacatcttttccccatactctcaaaatgcaagttaacccccaaccctgagcagaagaaaggagaggccccaggtacctgtcaatgagggaatcccgcatgctggtggcaatggtgctaggctgggcttcattcagcttgaagacactctccaccactgacagctctgtgctggttgtgtccaggccacagaaggcacaccagtcattcaccaccatcccagcagcaatcacctcactgcctcggttcacagtccccgcctgccaagggatgggctcaatgtgagtcacggcaccaaattctctccctcctcaatgaagactctccccaaaccctgctcctccctgacctgcagccccagtcccaaactgtggcaggtaatgacccagactcccaaacactaggcaaaaggatctgcctcgggagacggggttcagaggacaggaatgcttaccacaagggggacttgaagaagagaggacagctcatcctggtcttcaattgaagtcttgggatgcaccagccctccctgattgctgaagacacagtagcttcctactagcacctggtcggccactgtctgtctgaagacttccaccttgagcacatctgccagaatttcttctgtctcctgtcaatcaaagatattgtgttcagggctcagaacttacagccccagaaccaaggttctccatgcccagaagcatccaggccttggctccctgagcccctcatttctcctctgtacctcatatgaaagcctcacccagagaaaggaggaagtacagcttagagcagagtcaagggcagctgtgaagcccctaatattcatgcatgccctgaacagctggaggctggtctcaatatcacttctttcccctctcacccacagtcaaaagttcaacagtcaatcacctatcctggcccaggatgcaggactggatggttcaatctccccaatcatgaaggattcataccctccccagcttctttctgacacttgataaggcctctgttatcactattccaatgagtacctgaaactcaagagcccatatagaaaaaccacaggagagacccctaattgctgcctgttgggaaagaacagtggctaaccactgactaggatggccctgtgactcttgggtcaagttgggctgcctcaccctgtccaagtctgggtggaccaaggccacgtagtcattgcaggtggtgacattgcccaaggctgagagccgctcctccacccgcctaatctgcactgtgtctgggaggctgttgcgaatgtgttgcagctcctggtcggtggtattgttgggtaccaggagaccgtgcctgttccctggagaaacccaaattagagggtgaatacacaagatgcctgctgagccctaggggctgaggataccactcagcccagcccaatcagctttcccaggaaagctttaggcccagagcccagccctccaacccactgatctggaaaacacccagggcaggccagagaccacccaggaatcccaataaatcctgcctacttcaccatcaccaactgggagggaagctgagctcttggcattagctgtatattttgctacttaaaaactgagctgccgggcgtgttggctcacgcctgtaatcccagcactttgggaggctgaggtgggcagatcacaaggtcaggagatcgagatcgagatcatcctggctaacacggtgaaaccccgtctctactaaaaatacaaaaaattagccaggcgtggtggcgggcgcctgtagtcccagctactcgggaggctgaggcaggagaatggcgtgaacccgggaggcggagcttgcagtgagccgagatcgcgccactgcactccaacctgggtgacagagcgaaactccgtctccaaaaaaaaaaaacaaaaaaacaaaaaaaactgagctaacactacacacatagcagaatggctagattattattttttaaggcagagtctcactctgtcacccaggctggagcgcagtggtgcgatctcagctcactgcaacttctgcatcctgggttcaggtgattctcctgcttcggcctcctgagtagctggaattacaagtgcgtgccaccacacctggctaactttttgtgattttgtagagatggggtctcactatgttggccaggctggtctcgaactcctaacctcaggtgatccgcccacctcgacctcccaaagtgctacgattacaggtgtgagccactgcccccagccagaatgactaaaatttttacaagtcatcaattccaagtgttggcaaagatatatggagcaactgaactctcatactgagacaggagtgtaagttggtcaatcactttagataattatctggcatcatctgcaactactactaaatagtcacataacctgtgactctgccatgccactcttaggtatcatatacccagtagaaatatgtacatgtgttcactaaaaaaacatagcagcactattacttttttttttttttttgagacggagtcttgttctgttgcccaggctggagtgcagtggcacaatctcggctcactgcaagttctacctccccggttcacaccattctcctgcctcaacctcccaagtagctgggactacaggcacccgccaccacacctggctaatttttttgtatttttagtagacacggggtttcaccgtgttaaccaggatggtctcgatctcccgacctcgtgatccgcccgcctcggcctcccagagtgctgggattacaggcgtgagccaccatgcccggccagcagcactattcctaacagaccaaagtgaaaactgcccaaatgcactgtcgatggaatggatgaatacgttgtgatatacttacacaaaacacaccatacagcaacaagaatgaacaatctacaaatacacgccaatcaatttctgaattccaggtcactcccatcataaaatacacaaggactaagctaaaatctcccttgttgtcagaacttgcttcaagtcctaagggcatggttagagatcagagtattttaactgaataggaaaatactttgaggtcactaggcttaagtttttgttgttgttgttttttgttttttgtttttttttgagacacagtttcactcttattgcccaggctgaaatgcaatggcacaatctcagctcaccgcagggtgagctccacctccagggttcaagcaattctcccgcctcagcctcccaagtagctgggattataggtatgcgccaccacacccggctaatttctgtatttttagtagagacggggtttctccatgttggtcaggttagtctcgaactgctgacctcaggtgatccacctgcctcgacctcccaagcaggcttaagatttttaaaaattaaagtaaaagtaaaaaaataaaataaacagacttctaaaagtgacctcaatgagcagaactaagaaacaatgggcagcagtaatggaagacagatccagcttaatgaaaggaccggccgggcgcagtggctcacgcctgtaatcccagcactttgggaggccgaggtgggaggatcacctgaggtcaggagttcaagaccagcctggccaacatggtgaaactccatctctactaaaaatacaaaaaaattagccgggtgtggcgggatgcgcctgtaatcccagctacttgggaggctgaggcaggagaatcacttgaagagagtgttgcagtgagccaagatcgtgccattgcactccagcctgggcaacaagagcgaaaactccatctcaaaaaaaaataataataataataaaaaggaaaggaccaacgaccagaattaacagtgctgacaggtaggaaggtagggtagagatgtggtaaagggaatttaagattccaacgtaactgagcaggaagaccgcatatcttagctaatctttacagagacagaaatggatgcttagaaagagaaagcaccttgcccagtcagtggcagggagagatgagatacaaatcctcggctgggtatagtggctctcgcctataatcccaacactttaagagaccaaggtaagaagatcacttgagcccaggagatcaaggccaggctgggcaacacagggaggccgcgtctctaccaaaaatgtaaaaattagccaggtgtggtggcacgtgcctgtggccctagctacctggtaggctgaggtgggaggatcacttgagcctaagaagttgaggatgcagacagctgtgatcttgccactgcactccagcctgggcgaaagagcaaaaatctggcctcaaaaaaaaaaaaaaaagagaaaaatccttctccaacactaggaactaggtgtggaacttactgagtcacttaggtcaagtctcaacttcctcatcagtcaagttaggccagtaactcctaccttctagtgtctttgtgacgaaggaatgagaacaggagtgaaagcactttacattatttgttattactattatccagcagcctttgctagagggttgccccgatctcctgacgcttggcctgagagattctatagtgcccagagataacagatgataccctgggaatccctaggtcactccgggttccctccgggggtgtaattaatggtgcttggagaccactccctccctcggcgtcctccacctgccttacccacacacatgcgcccgatgatgcggcagccggcgatagacgcgtgcaccacggggatggtatcggagagctcgccctcgaacacactgtagggacatggactcggtggtggcggggcagaggggccggcaccctcccactgccggagctcttgactcctgcgcacgcctccccgccaccgtaagccccggggctcccgccgcacctgtagaagttctctgagcctccgatcgctaccagacagtaggtgttggtgagcttggcaaagcagccgatctcacagttgttctcgaacgaagctcggaccgccatgaggcctaggggcggcggaggcgggagttcaaggccggcggatcctttcccaagtatcccggcctccgtccctcaggccccgccgcgaccccgcccctctcggcctcccggcccctccgtcctcgggtcccgcccactgggcccccaccagaacctccggccctgaatcctctggcccccacccctcccgacccaggaccggagctgaccctcccaggttcccctcacaccagcttaccaagtaaccagtaacaagctccgcacgcggcgactgtaccttggactccctaaaaaggtttccgtttccacttccgtccagggagacttccgggagagcccggcgctccccgccacgcatccagcccctctacctccggcctccggcggactctatggtcgcgagcggtctgggcgcgaccccgcctggccccacgcctagcctgctcgcgttcattcattcattattcattcaggagctttttaggagctgtcatcgacctagacctccggctggtcggttgtgaggcatgagggagaggaggggccaggagtgtctcgcggaagggttgatgatggaggtattgatggaaatgaagccggaggaagggcaggtttggggaaagggatgagtccagctgtgccttgagggacagaagtccatgtctggagcccagcaggggagtggagtgctgacgaatgagatgaggggctgaagacgggtggactagaagaggctacccatggagagagttccaggaggcagaagtgcggccagaccgaggctggagaaagagcgcagccagagacggaaaggcagccaggctgcaggtgctggagagaggggaggactgaggaagcaggggctcaggaaaaggctggaaaggggtccagggtgggcaaggatgtgggtgctggttggcttccacgatgtgcctctcgcacggcctctatcactcactcagcagccaacttctgtccccaggatagtgatgggggccaagggccctgctgcacacttggacaggatgaacttggcccacattttgtagaatctgcaaaagccccgggttctctcaaaatgtcacagtggtaacttggagcccctggactcccccaattcctccttcggcattcaccctcctccaggggtttccccataattggcctgaatggtgcccttcccattcccccaacgtgtccctcccataactcctcaaagttcaggatacaccaggcgctgtgattcacaataaagtctgcctttattgatgtgtatcatgtttactatcccgggtaagtggtgagttcaggaaaatggcccacaacctgtcacagcctgtacttcaagagacactcagcaagatgatgacgacgacaatgatgatgatgatgatgatgactcagcaagatgatgacgacgacaatgatgatgatgataatgatgatgtgtgtgtgtgtgtgtttccgggtatccacatactctgctcttcctcactcattcacctcagacccactcagtcctctttagggcatctctttcacctgattctctctaccaaaaatttttctaactctctcctccctctgtccaaaacctccccatccttcagggcctggctcaaaggccacctccatctcctctaagaaagttttctgactactccaccttctccaggactctctgccctttgttttctaacaccctctgtaactggttaacctttaacttgatatggctctgaccccttctccagcagcttgtgcatttcacctctgtccccaggtctgagtgtgacccacctgtcagctctacaggcccagcacagggctggaaacacagcctagattcaagaagatactagttagggtgtgtgtgtgtgtgtgtgtgtgtgtgtgtgtacacaagaatcttgagcccagagagtgtgtctgacctgggtttctagacacctcccttccccagtctgggacctgagcaagtccagagtctcggtggacagaggaggggcctgcccttgccagtgcacccccgatgccagtcctttggctaggactcaaagcggcttcggagctgcttgaacttggacttgttgtacttagtgatgaggtccagtttgctgtgacccagggtcagccgtttctcatccctgaccaggtcactgttaccaccattgagatggccacccttgggacccccaggctcagttccctgcctggccccgtgcaactgatgatacttggtgatgaggtccagcttgctgtggcccagggttagccgtttctcatccccagacccagctccagccgtgcgagcagggcttgatatcgggagaccattgggcccaggcccctcaccacggaatgggccgaactttgtgatgaggtccagctggctgtgccccagggtctgccgccgctcatctggtgcccgtctggcaggtctggctgaggagttggtttcaaggggcactctggaaccctgggccttggggtactgcatcaggaggtctgattggccacggctttggtttagggacagcctcctgtcctccagggcccgatcaccaggtctgagggaacccaactcaggggcacccccagtacccagggctcgggacaggagatccagctggctgtcggcctggcttggggacaacctcctgtcctctggggcctgctcgccaggccgaagggggcctgagttgggggtaaccccagagtcagggtctcccacttctcgggctctggggaaggggacaaggagatccagctggccacggctctgacttggagatgccttcttctccttctcctccactgtctccagggttgtgccaggtacccatcgaccccgcagggggctgggctcttggcttcctgggagcccattctctgggaaccgggacagagctggggcaccccgatggaactggaggaggggccgggagcgaggaagcagaggtgaccccactgccaaggttaaggggctggtactattatggttgagggcaggggaggactgggaccatgggtatgcccctagcttgccgagattggccctatagagcccaggaggggagccgtggttagggtctgacagttggcgatgtagggagggctggccactggcctcacggcgggcaggacccagggacgaggacaccacacccgtatcactgcaatcaccacctcctggtagagcgaggtaggaggagcgacccataagcggtgactgcttgatgctgctgaggctggtgctggagggcagggacgacgtggggcttgggacatcaggcctgaaggctagggccacagggggaggacgcagtgcccggggagacagcgggtcctcaccgccacagaagccctccacaggctgcgactcagcgtacagacagcggaactcccggtcaaagtcttccacgatgcggcccctcagctgcagcaccatgctagtgtgggcctggctgcaaagccaggtgaagctgggggcagagggacaggggggtcaggaggcaaagtgcaggatcctgggggtcggcaggagtcacagccaggggtgcatacctggtccagcacgctagacccaaaccccaccaccacgagggctcacagcgaggggcagagctccaactccagagtctgtgcttgccctagccctgcttagtgtgtgacctcatggaggccccaacttccccatctgtcaaatggacttgggggaggttccctgaagtcactccagttccaatgggcatagtcattttctataccaagggtattaaagtaatcattcccctagagtgagctcctccagggccgatgcccccgacaccctcccctgagcctggcatgatgcctggcacatggcaggtactcagcccgtgtccgaaggaaaggatgagtggagggaagctcagagctgccagccagtgatgcagccccaggccccccttgcctcctcgtgcctgctcacctgtaactgcccgccaccacttgctcacagtcaatgaggacgaacttctccagggcctgccccgtgaagcggcggccagccttgctgcagtatgtgtccccacacgtgctccgcacacgcatgttctaggtggaagtaggttgggggtgaccttgagagagtgaggctcaagccatgtctctgccccatggggtctctaaccccagacagctaagggaacccaccccccactcccagtgccccccagtgctgactggccacccactggctcccctgccctccctgactccccgcccacacccctggttactgcccctggtcctcactgaccggcaggtgctccccattgaggtccatcttgtagcacatctccaggaagtgcctcaggtgctcctgggcaaggagcaggtacacagggacaccacgccggcttgaggcctccatgaggtcacacagaagctccatgtcagtgaatatgtccatcaccacagccaccacctgggtggggggaggcacacgaaagctcagcgctgcccagggcactccccacatccagccaaacctggggcaggaaactgggcgccgggaaaagagtactggactgaaaatcaggaggccagagccttcaagagcaagtgaacaggaagggcacttagcagtgacctagcccagggcttcttaacttgggcacaggcagatttgactgtcttcttttttttaagagtcagtgtctgtctcactctgttgcccaggctgcagtgcagtggcgtgatcatagctctcttctgcctagaactcccaggctcaagcaatctcctcccaactcagcctcccaagtagctggtattataggcatgtgccactatgcctggctaattttcttttcttttttttttttgagacagagtctcactctgttgcccaggctggagtgtagtggcgtgatctcggctcactgcaacctctgccttctgggttcaagcgattctcgtgtctcagcctctcaagtagctggaatttcaggcatccaccaccatgcccagctaatctgtatttttaatagagatggagtttcaccatgttggccaggctggtctcaaactcctgaccttgtgatctgcctgccttggactcccaaagtgctgtgattacaggcgtgagccaccacgcccagtcgctagtttttttttaattctaattttttgtagagatggggttctcacaagctggtcttgaacccctggcctcaagcgatcctcccacctcagcctcccaaagcactgggattacagtcaaatcccagcccagatttgactgtcttgaacccctagctgtttgaaagcatttgtgtgcatccttctgtgcaccgagtgtttatccatcatcagattctcaaagatgactgtggatcagctgtgctagtccaacactccctctgcactgagccccagatgggacagcagtgagaaggagaacccagaccccaattcccaggcaagttcctggcactcccccgactaactccagcccagctctgacccagggactgtctgtctgaggctcccttctccagggtcacagctacaagccacttactggggtcttcgctgccctttcccagtcctgcctcagtttccctgtgaagccacagaggtctggtgtgaccccttacactgcagactcccttacttgcacccatgccaaatggatccaagttttctgctcagttgagggctgggctggggcttgtgcctccatcccatataaagggctgcctcaaagaggcccctgaaaccttcttggcacctcccagcccccagctggcctttcttcccatggcatatatctgctatgagagtcttctctcccaggcagggccgagaggcaggaggtacagagcatagcactccagctctggagtcagaaagaactgggttcaaacctggactctatcacttcctggtgacacagctttgggtgagtcccttcacctctggaagcctcaccttcctcatctgttaaatggagataatgatagccatgtctcagagttacagggaattaaatgtgaaaatgctcaagacataacagagctctataaacattgggctgcagggcaacgcagcatttcccaaggtcactaggagtcatgacagcccagtgcacgaacctggctcctgacccaggatagaggggtctaaatgggggctgagaaggcgaggcactgggggatgccctagttcacagcacaggcctggccagggtgggggaacaaggacaggcaggaagatcaaagaggcaggggtgaggaggacgacagcagcagcctcactaataaccccattcctgatgccaatcaggcctggccgtcccctgcctggggcacaggaaggcttgccagggaggctctggaagtaccggtgggatcccagcatcctggcttcccatctctgcagcaggagcctaactctccctcaaaccctgccagggatcatctcgtccattcccctggagtcggaggccagggcttcagaagggaagctgtgctcgtgtgtggccagagcctttctgggtgctgaccacccctacctgccctcccaattctctttctcctgagctcccgctccccatcactgagcccagcagcctcctctcctccttcctccttggttccaaagcccagccctcaaggccacgccaaagaggcccacacgctggccccttcccctgcttcaggcccagctgcagatgtggtgcaggagggtagggggcaactagggacctgagccagcaaggagggccggactggtccccaggacccaagtcagagagcccctgtctccccaagccctgagctctatgtcaccatatggacctccctgggcaagtcccaagcccctctctggcctcagtttcttcttctataagtgaaggaggtgactcagatgttccccaaggttggagttcttagtgtggggatcataaaactttttgagaatctgatttaaggcagtggagcatcttccaaggtaaagatgcagcgaggactcctccctccaacctgcaccacttcgtgtgcatttcaggggattgtggagtccctgacacccatgccctgttctatgctcatccatactattcctgggtaccaagcagttgccaaggtaaatatgggatgtcccccttctaggagtttgcaatctaatagtgccagaggtgctggtcctcattctgcccctaagtcgctgtgtggccttgggctggtcccttccctctctggacctcagtttcctcctctgtgagatgagtgatggagagatgaggcccttaccgtgtgggcctggctgaaaaggaagcgcagcaggtccttgatgttcttggccttgtccctctggaagtggaccacagcctgggtggggctgaagcctgtggcctgtggcacctcgggccagcccaggtccaggtctggggggtctatgtcagaggccatggggaagtaagtccctgaggtgacttcagagagcaggctgaggcggtctggcccggaggcctcctgcccctgagcctcgctgagctcagggcccccgcgcacatggctggtcatgtagtccacatccagggcgctcaggaagggcagctcccgctcctcggagatgacccgcaggtaggcagcctcaccccgctccaggagggcgtcggccgccagccgagccgcctcgctgtgccgcagcaccagcggtgagctctcccgccaccacggcagcttcagctcttccacccggccccgcaggggtcccgccatgccctgggctcccaggaccccaggccccgggcctccgaacatgcctgccacgcggctgcctcacccgccggcagggcccatggcccgcacgctgggctggctgcagcaggaagaggagaccagcagaaccgccttctgcccgcccgctcgctgtgtgtgtggcagggcccccaaactgttgccaccctaaatcagagccacgctccaccctattgcccctggcctctggaacctgtcaggtcagccccacctgtctgcctgtgttgggactcgcctgcccagggaagcggcagtgccaggccctcggtgcacactcctgcctccctctcttcctcccagcaacgccgccccatccccaccaggctcccagcaagtctccaaatgctgacttcccgggacccacagaggttgaattacagccaagaggggcccaggcgactcaggaacacacactcacacgcacacgcacacacactgcaggtgggtgagcgactcaagacacccaggaaaagacatgaacacccatgcagatggacacactgacaactgaccgatacacagacatggagtgtgggctgacacagaccgaccacacattgtaatcacatccacttgcataaactcttcacccaaacgccgatgtagagaccggccatgacccccacaacacataccacagtggatagcacgtgccctggctcaagtctgcaaggccctgagagctgaacgactgtcacatggaatatccaaggacatcaacgctggtctgtcccccagccagccctctttttgctcccataatcgtcctgccactctccatcatcttaactgtggtgctcacagccccctggctctctcccaccccggctcggagctgtccttcaagaacctagagcagtggctctcaccctgaccccaggggtggtgagaggtgatgaaatgcagatccccgggccccaccctcctggaaattctcatccagaaggtgtccgtaggcttctggagcttgtcttttttctttttctttttgagatagggtcttgctctgtcacccagtctggagggcagtggcgcaatcacagctcactacagctgtgcctcagtttctctggactcgagcgatcttcccacctcagcctcctgagtagctgggattacaggtgcatgttaccatgctcggctacttttaaaatttttttagagatgggatctcactatgttgcccaggctgatcttgaactcctggcctcaagcaatcctcctgtctcagcctcccaaagtgctgggattacaggtgtgagccgccacacctggccatttttcttttttaattgagacatgatcttgctctgtcacccaggctagagagagcagtgatgtgatcatagcttactgtaacctcaaattcctgagtttttaaacaagtgcccagtgcactgtgggcagtgggctaaggcccacccctgagacatgctgttccagatggctgtgcttgcaacacccttaactccagggatgttcttggcctggtggtggccagaccccagccttcttcccctcctccagggctgagtatgaaaatggttggaaggttgtttcagagaatgggcggacacactgcaaggtcaggaggcaaacagggcaggtagatttctgacctctgccccaacaaagattaaagtcctggagcatgtaccgtgtgtccttcggaggatggtgagcagctttgctctggggaagggggtgagcaggtgacagctgcagctggggagccaggctaggcagaagcggtcaccacctttccacggaggcatgaggtccagcgaggatggcgggaagcgcagaagacctaaagccgtgcctcgcagcctgtttagcactaagcgcacttggtttatctggtctgcgatcatgtccggaacacagggtcttctgtgtccaaagaacttgacacacatatagtgggagggagctgggtgggatttagaggttccggagttgagctgagccctaggaccaaaggtgaatggggctagggctgtgtcttcaaggaccctataagtgaagggcctgggggagcatgggggagccacaggtcaggagttatggcctactccatcccatcccaggtgcaggagcaccgggcactccaaggaggcccttccatgggggtgaggaggctgcaagaggggcagaaggttgagtaaacaaagccagaccgtgggagggtgatgagctgtgggggcagccgaggtggcagggccatcattagggccttatctccagatttgtttgaaggggaggaccaaccagggtcttatctgggtggtagaagtgctcccgggagggagggaggcatgtttgcgtgtcactgagttagttttgtttatcttgcagtgtgtatacatctacttcaggtacatatctttggctctgtatcttttaattgtggtaaaatacgcataaaatttgcctttaaaaaataattcgtggccagacgctgtggctcatgcctataatcccagccctttgggaggccgaggtgggcggatcacctgaggttgggagttcaagaccagactgaccaacatggtgaaaccccatccatctctaataaaaatacaaaaagtaggtggctgtggtggcaggcgcccataatcccagctacttgggaggctgaggcaggagaatcgcttgaacctgggaggcagaggttgaggtgagctgagattacgccactgcactccagcctgggtgacagagcgagacttcatctcaaaaaaaaaaaaaaaagaattagagatggagtcttgctctgttgcccaggttactctcaaactcctggcctcaagcgatgctcttgcctccgcctcccaaagtgttgagattacaggtgtgagccactgcaccaagccaaaatctgctattgtaaccatttttaagtggtacgctttaagtgtcgtaagtgcattcacactgtggtgtaaccctcaccaccatccatctctagaactcttctcactttgcaaaactagagctctgtacccactaaacacgaattccccatttccccctcccccagcccctggcgcccactattctgcttcctgtctctatgaatttgactcctctaggtatctcatttaagtggaatcatacggttttgtccttttgtgactggctcatttcacgtagcttcatgtcttcaagttccttcacattgtagcgtatgtcggaatctccttccactttaggctgaataacatcccattgcatgtatgtagcatgtgtgtagcacatttagctcattcctccatggatggatgcctgagttgcttccaccttttggctgttgtaaataaggcacaggtgtacaaatttggctctgtatttttgtatacttccccccacgcccaggtttgtactagattccttttttgtacataagaaaccactgaatattggcaatttcatatggtttgactaaatatatacaggtgtacctatgcagaactgtacctgtgcttgtatgtgtgtgcacgtcctgtctgtgatgtttgtgtgcccgtgtggcacggcagtgtgcatggacctgtgtgtgcatgtgtgtctgggtggcgggatagtccttgagtcggactctgtgttgcggtactggggctgtgtgtacaggaagcacaatggagaggggcaggggtgggaagactttgttgaaaggcaaggggttccagtggatcccggacatcctgataatacttgtgtgcaaatcaaatcaaatccccccaggctgcgggaccagctgcctctccctaggcagcccctccctgtgagttgagttggtcaagggcaatgggagggcagacaggtggctcccggcattggggctgggcctaggggtggtggccaagggtgatgggagcgtccagacagacccaagccctgtccctggctgaggtatgtcaggcacaggccccttaatgactgtaattaagaggaaggaaactgttttcctgtataggaggtgtgtcaggcgcctgcctggcatcactcagctgtcctggaggccacttagccttgtctattgtctctcacaagccaagcggcgtctgggcaggcaatgtcatgtagggtagggggagcagaggctgggttgcagccctccaggtgcaggctgctctgaggccagtgctgccgcatacctttcctctggcaccccgggtcaggagagacagggctcccgcagaggagcagctgggactgtagggcccggagtgccctaccagggatttggagtgcacccaaatcccttgaatcaaggcaaagtggacacatgctgaagagtccccgaggctggcttgagccaggtagcaaagggtgagaaagatttcaggtgcagaggggtaagtggagtgttcctggctggagaaagagggcaaggacatgcccaaggaaggcaggtgggggccgtggtgcaggggaagatgctaacaggaaggctagagccgcactaggaagagctcgagggccttctaaagtgctgggttcttacctagagatgatggcacaaaggctgggaagactccagagcatcgtcctaggataactcagaaacagctccaatggcgagagtgggccaaagcaccagaaacaacccacattggttgaacccagtgtggttcactgttcactgagtgtgacacaggtctcaggaggtcaccattccgcactcttgtctcatcctgataccccatgggctattgtgccactggactgagtcgaccccctggtaggaacacaggctctgccacttaatgggggagccgaacaatcacaacttctctgagtcacagtggctgactctgtagagtgggacccacactatctcctttacagggttgtcttgaggaatatatgggctcagctacgccaagtgcctggctgagagcagctgtggttgctcagtacatgctgaagtccagagctttcccagttgtgaaaggacaggggctcgatgaaggcctgaaagctcaggaagccaccgggggagctctcctggtcagtctctggttccttctagaccaaaggctggtgccaaggccaacacggtcccagccgagtcagtggggtgtggtctgtcaccactgcctctgagatctggcctctcatcacacgcctgctcacaggaggcggggtgtccatctgtctgtctcctgcattttatttctccatttgttttgaacttgggaggggaagaaagaggtgcatctgctgactcctggagccccgttattgaggcagcctccccttcccaccccctctccctctgtccaatcctcccagcatggatttagtgtccaccttcagccggcaggtgacccaaagatgagtaagagtttgtctctgccctggaggagctcacagttcagtggggaagacagactcataaataattataaaccatgcattaggctgaggtataaaccaagctcctggggtttagagcctggacctattgaagaacctcagacgagccatggccccacctcccgccccttcaagcaaggcacagcgcagtggcgggccctctcccaagtgtgaggtgaatgctgttcctggccacagggagagaaaaaaagtaagagcacccagcccaggcccgtgggtgctggttcctgactgaaacctgcagtgaggcctggcagggcctcagcctcccccgtccaacgcgctggctgggcgggaggtctccaggtgcttccggcgctaccgctgtagtccatcacttgttgacgccacgggttggtgcttggaggtcccttcctggaaattccccagccagggtctccaggatcttttctccttgttctcccctccacacggaaaaggggagcccgtggcctggtcagggtctgggtcctaggctcaccaacgtcactccagggaagtcccctggaagctacagagaacctgatgggggagcggggagggtcggggccaggggcctgaggtctggcctccccctctctaaggccaagcccagtggatagggtgggtgaggcatggtaggtgcagtggacagactagaagtgggaaccagagcaataggtacaggagggctgctcccaggggaagcgttcgaacacccctgccagctccacttccctcccactccacccccatagctgataaactctagatcgagaccagctggcatgagctctcccttcccccttagccctctcctcagaaactccttttccccctatcagtcctcctaatcgctggtctcaggaaaggattcccttcaccacctccaaagccaggcccttgttctcaagatcaggcttccatttccagagggatctcatcggagtccctaacactcatgggaagttccctactccactaagtgcttagctcatcagggtgcttcctgcccccaaatacatcttcagcacgttcctgcaaacccccttgtttcaccccctcttccgcctcctcccagtatccctccatctcttctcagcatgctgctccgagtctccttctggaagctctcctcttccctgggtccagtctaccttctgcactggtgcctgctcttcccgccacctcctgtgaatgctccttgcactcccaacccagtctcggggctgccctcacctccgggagctcatcaacttcaggatctctatacccaagacaaagccaacatccttcgtccctgaggtccatcctgaggttcgccaaggtccttcctcccccatgcccttgccctccctggagcatctctagcatctgaagtccatctgccaccagactggctccccacagatgcaaccaaggtgcaccaaaagcaatggagtggaacccagaaaaaatgactgttcagctttgctgcagggtcaccttgcaccagcaagcagattcttctcagtgcgcctatttccctattgcatcatgggtgcagcaatccctgccctgcccagctcatagggtgctgtaagtttcacttgaaaaaacacaacacatggccgggcgcggtggctcacacctctaatcccagcactttgggaggctgaggcaggtagatcacctgaggtcaggagttcgagaccagcctagccaacatggtgaaaccctgtctctactaaaaatacaaaaaaatttagcagggcttggtggcgggcacctgtaatcctagctactagggaggttgaggcaggaggatcccttgaacctgggaggcggaggctgcagtgagccgagatcacaccactgcactccagcctgggcaacagcagcaaaacttcatctcgaaaaagaaaaagaaaaagaaaaaacacaacacagagaggattcttctcctccaaagaggatcttctgccagacgtcaccatctctgggccccagtgagttctgtgactgcactctcttcaggctccacattaggcctcaagtcctgatgagttttttctcggaaatgtctctggggtttgagcttccctttgaattccatctgtcacccccggcatctcaagcccagatggctaaactcccttcctgacagagccaatccatcctggtaccactgtctctccactgccatcatgccccagtctttaccaagaatgcgcacagtggcttcctgctgcctggcagctgatgtgtgatctgtgctacccctactcatggtcccacctgatctctgcaacccttccttcccttagcagctaactcaacagttgctgcagtctgaagagcttcctgttctgtgccttcaactggacagctagtcctcaattcccgttttcctacctccttaagcctcactcttcacagcctgaagcggtggactgggtcagagccaccatacagggtacatctgggcattcccctcctggaatatgagcttaagaatcctcacctgcaaggcggcgagtgaggtgacaagtgaaaataccaagcaagcctggcatggagggaaaactcaaaagatgctggctgaagtgcggcctgggcttcaacctcagtttaagattcaccccgtcttgtcgtacagcattgctatttctcatcggaagaaatagcgatgatttcttttttcaaatttttaggtaaaacatcaatcttaggggtactgttcagtgtttctcatttgaaaacctctataatacagtcttctctgaagagtaaggaagacatatgtttcttctgatgagtaagtgtacttccttttatgtgacaatgggaactctacaaccttagggctttccattttccacctttgaccaggaagctcagagcaaggtctcatactcaattgcaaatctcctggctgacctgggggagggaggcagggtgacatggggacaaagcagggtccccagggtctgtcgtgggctggagcactcttggccccttcttatcctcgatcactctttctctaggcccctctaagcttcagtcccctcacttgtgttaaagggataataaaaatgatgagggcaatacctgttttacctgattgttgtgagacaatgcatttacagtattttataaaattttaaaaaagtcatatgaaagttgctcattagcagtccaggttttccaacataattattttccctctttttccctcccaatacctggatctgatctttcaaactttaaggatttttttttttttgagacagggtctcactctgttgcccaggctggagtgtggtggcatgatctcagctcactgcaacccccacctcctgggctcaggtgatcctcctacctcagtctcctgagtagctgggactacaggctcatgtcaccacacccagctaactttttgtagagacagggtctcactgtattgcccaggctggtcttgaactcctggactcaaccaatccgcccacttcggcctcccaaagtgttaggattacaggcatgagccactgcacccagcctacaattttattacaaactgtgtctcttaatctgctgtgatcttttctggaagaatacagaatacaaatattaataaatgacaaaatcattcctacagagcagtctccctgaaggcaagaaattgtgtccttcacttgttttgtacaataatgagttacactagaaaagcatttagctatggaaagaactttccattttggttcctatgctaagaccaaagggagtgctcaatattaagtcgctaaaataagtgaaactgtatgggtcacactgagaatggtccagaagggggctttttggttggggttgtattgataacacttggtgatttagtcacacattcattctttcatttatccaagtatacactgatgctgatcatgaatcaggcatttggctgagcactggaaaaacaacagtgaccaacacaaacacagtgtccactccacgctgaggcagctcacagtacagtgtaggaggtgggtaaaaaaatcattttaacatggtaaggtaagtgttaccagggctaggtgtggaggcttatgcctataatcctagcactttgggagggcaaggtgggaggatcaacatagtgagaaactgtctctacataaataaaaaggtaagtgctccagagcagagaaccacgtggggagcagcacggatatcgtgactgtacctggaggggacaggagagggagggacaaaggttctaggtagaggacacatagcatgatctctccaggtaaccccaagaggttcagtgtgctcagagaagagatgggtagactcataaaaacaggaatggaggcagtggccaaaccaagaataagggtagcctccaaggaacctggaatagatcttaaggggagggggattggcagagtcagggaaaggtgctgatggccaagaagtgagggctcaccaacatcagacacgatagatccaatctggctccttcaaaggcagctccatactgcaagttgctgtgttgcacgacgacaaactcctgagcagacaggactagctctgtaggcagggaccatcagatgctggagggactcacccagggcctgcatgaacactggctgactgggatgctaagaaggggagtcaggttctggaccagggctggaccaaatgacctttcaagttccttccaaatctgagcttccaggattctaaagcaagcccggtagctgaactggtgccatgagctgggatctgtggctggggagctaccctgggcagcaaatgggttaaagctcaaataacttttatatatgaattaatgtgtagagttgggagccaaaatctgttccattaatttttccatccattccaggagcagttaggtacacacagtaaagtttattttggtgcatggtatacttcactccattaaaaataaattaatcagcaaattcctgcctggctcagctctggtttatgtaaatagtgcccagctgtaatgagttacaaggtgttattatctcacacacacacaggaggcttcactctagagctccgctcgcaacaaaagcatcttaaataaactgagagaagcggtttgatttgtaatgttttcacagaagtgggatatacctcacccatatagagtttctttatatgactcattttatagcaagttaaatgaaggaagtttgatgggggagggaggggcaatatggttccccaccccctttcttcactttaagaaaatcccccaagagatgacccgcactgagggaggaggggctggtcctcaggtgctcagaccaaggtggctctgcagcacgtgcttcagaagttgggaagggggaccaaagctgggcacaggtctgggtctgctacaactaagccaggaggaatgttctcttctccccagtatctcatgaaaggggaggccaagacaggagacagcatgttcctcattcagttcactgggagtgacaaaggtgactttgttctcaaggcctccttccaaatgacttaggatgtgaaagcccttggtcatcagaggcctcctgggtcccagacgacaggcctggctggctgtatcttggcctgaacagagacacatctccatgaactagaggcaagagcagcagagaccatcccagcctcttccctttctccgtctctaactgagctgcgcggtgccctcattactgcgtccaccatctcaggcaagtttctaagtccctggaataaagaagggccatggcagagagaagtctctgtttcttttaatggccaactcaaccccatggctgaaagccgagggacaacgcgtggtcaccgaccggactcggcagcattacaatctgctcctaggccacagcaggccctggggggtttcccttttgaacctacaccatcccttccttggcctttgggaaaagctatcagtcacatgtagttgctggagggggttggggagtgtgtgctgggggactctcactcggggcttcccctaagggagaggacaccccgggagagctaggggttctcccagccctgtaccccagcagatcagactcctgggcacactaagaggaaactcaacacaaatggggccaggtatttgacagatgctgttcagaggtcagttcaggccactttctgcagggtcctggaccaacaggcacttctctcctggaggttcctcgaagccagctggcgggccgtgcggagggcccagcccatcaaagtccctcgtcgttgtaagtcggagaatggggcttcaggatgctctgaggattcttctccactagagggcgccagctcacctcccctgtcagaagcagatcctccccgttcatggagtccaggtactgtatctgcaaccaggggagggggaaggaggaagcgacagaggcagggcagaggtgaggagccagcgtcaggaaccagcctcccagaggagaggaaggaaggggacggggcatgaggggggcttctgaccatcccaggtcccagaccaagccgtcccaggccaagccgtctctgatctcctagataatttcactaaggtggttcagagaaagcagtcactggggagctgggtggcgggggcagttagggaattccctatcacacctctgaatggagacagacacacacctcccaaggacacgtctcccctacacgccctccctagacagctcctgcaggccaggaagtcagggcttgcagcgcacacagccatgctgtccaccccagcactgctgggtgagagtcctgattctgtcccttcccagtgctgctacccagggtggcagcttcccctctctgagatttaagttcccttgtcttgagagaggggatagaaacaggtacctcacaggacacatgaagagattcaacaatatgcatatatgcagtgctaggcactcacgctttaaacatatgtatgcctctgttgtcctctagtgggcccctggtcagtgggccccagtatcacctctctaggacagtaggggcagacagctctgccattaaaatggtcatcatccagagaagccactgctgcagggccaggagacttcatcttaggctttaggtcattcccccttccaagaatccaccactctggttgcttccgcttccagctgctgacgcttgaactcaaccccagcctctcgcacgtgtcttggctctggattcccacctgccctgccatctcttccctaaagcccactcctcccttacagtgactccatttctgcccccagtgccacccctctgcccacctcctgggttgaaaatctcaacagaacctctggttggctcttgggccatcggccacaccaaacagtctgctcaaggcccagctcctgctcttcctttcccggccttcagcactctgccctccctgtatcacataacaggctggcttactccagggttagccgtgtgcctgggcttcctcaccaaaccatgagctggctcctcgagggcaggactgggtcttattaatcgttgctttcccaagagtacatggagcagcaggtgctcaaaaggtttgctgatagaactgggtccccaccaaagctccctgctttcccaagaaccccttcacggtttttccactgcctctcactggggccacatgggacctcttgtagggacaatggttgtggcagccccttcctagagggccctcggagaagtcccagtgtgtcttgttggggcttctggcacaagcccaccatggcagatggaaatgttgggcaggtctctcagaaaacacagcatttgctttgcgaattgctactcccgtctgagggtgagtccagtcaacagagtatcagaattctctgtgagtggggccctctggccatgccgtgccctctccctggctctagcagatttgaagagtggtcaaacagaagtcctggctcctgggattctctaccctgtgggtctgcagagccccagtatgtggtttttccagcagttaacaagctagtcctatgggccctgtcttctcaagagctgaagtccagccttgcctttcctggttgttgaagaccatgaatacaagtgaacaagagagtaactgtggcgtgacaccccttcagctccaggggccaggccatgaagcaaaggtgtgactcatggcacagcctgagctgtctgaggcagctgaggcctcagtggtcacatgaatcacacagcttggggccctagggcagctgtgcaggctgactcactgggaggccctggaagagcctctatgtcctcttcgctgccagtcagctcactcatctatcaagtatgagtttcccatcaatacaggatctgagggcagggaggtcaaggaattaattccccggggcttgaggacagctatgtgggtaagcagcccccactgcggagctttctcgtagaagctttgatgtcggggagccctggggagccagaggggtgagaaactgaagtggggggactctacttgactgtggagagcatctagcaggaagaggctgtctgtgaaatgctgcctgctgcccagttttgctggaagtcaggagcaggaaacaaatccaagtgggtagagaaggggtccacagtgggcagctgctactacaccacgtgctcatatctgccaggactctgtgggcccagctgctagcatagcactgggcgcacagtaggcaatgaggtgcacagtgaatgaatgactcaaagttcctgagggcaggagactactcgatgcctctttctctctctcttcccatttcccgctccctggcccagttcatggttggacatacagaaggcgctccttcttcagcgtctagtgctgatgtgatctggtcagaattctctcaggctggtccttggtaactccacctctcatgatcccctgaaagcccaagaggaggacccactgttgccaggacttgggaggggagggaaagggtcactcacctgtttcctcacatactctaccagcaattcaagatgtcgagggtcttcacatttccggttgaagaaggttctccagagggcagcggccagcccatgatcatctgaaaggatcccctggaacatacagcacagcagtggtctcctgagggatccacagagccaggacacagacggtggggatactatgaacatgctagcaaccatggaatcagctcagaagggccctccacgcacaagaggaaaatggggcagtcacacagtagaggtggaaggggtcttacaagggtatctggcccaatcccttcattttattacatacagagggagaacagggggtccagaggggccaagccaccagttaggtgatgcagagctgggactcaggcagtactccgtactgcgcctggcccaggcaacacttgagaggctgagaagagaaacagtagcagcaatgctccccctgctgtccatagcagcaatgctccccctgctgtccacagggcacgggctgggaatattgtgaatgtatgtttctcccaggaatggaggtgggcatggactgtgccttcttgcttggtccaaggaccaaggcaaggcaactggtccttgggggaagggagccagctaccttgtcttcactcttacccaactctgggcccagcctctccctaagtaggggaacaggatgttcagcaggattgctggggccacagagggccaggctcagagcttgcatgtgtgtgtgtgcctaacgctgcctcttttggcagaggagacttctgttgggaagcttaaagattacagagcaaaataagagccccagccaccagctaaggacattttctagcttggacctctagaggagggagggctgagagtcttgcttcctggggtgaaggtggctgatggaacaggccctgagaagttgctctgtccaggtgccaaggtagtgtgtggaatcgatgtgctgacttggagttagaagggagatcaagtcctaattccacctctgccaagatcagtgatggtggcagctgactaaaccaaagtctcaatcttctacttcttcaaaacagatgaagttacctgctctacttatagcattcttgaactatttgttaagtgtaatctgttggatacaaagattaggagcatgctttggcagacagcggggatacagtcaaaaccgtggggtctgggagccagagcacagagttcgaatgccagctgtgtcacttgatggccatgcggcctttaagaagctattagccattcctgagcctcagtttttcatgagtcaaacaagcctaataatacctatcccacagagttgctgtgagaattaagagatactggccatgaatggctctgtaagtggtaaacattacccaaagacccaggatcactttattcgacattttattgtggtctgtcctcttgggcattgtggtatgtgaggtctggctccaggcctgctgccaacaagggccatgtccagtatggggtgctgacagtttggtagaaaaacattccacctgttccaaatgctctctgataaaccctccttacggttccacagcttaggactgtcctggcacaatggctgagtcaggaaaactggctttttctggcacatggggacaggagcagaggacaagctcaggcacatcacccttctgcaaacgatttgctagcacaacagcgtgcctgtgtctgctgtgcctgggcacatgccagagcgctgctggcagcaacccacatgtgctgtgcagaaaggaatgggattgggagcgcgtgttatggggacctggagaatgggcagagcccaggatgggaaaacaggcaactttagcagcgggtgagatggctgggaaggggcaaattcataatcaggaattcctgagccatcagaaggaaaaggatgactcaggacccactaatagtgagaacaacccaactgtttcagactgttagggttccctcacacgcctagctcctaatgattatgtttgccaagtagaatagatattatattcccatttgctttgctttgttttgttttgttttgagatgaagtctcactctgtcacccaggctgaagtgcagtggcatgatcttggctcaatgcaacctctgcctcccaagttcaagtgattctcttgcctcagcctcccaagtagctgggactacgggcatgtgccatcacacccggctaattttttgtatttttagtagagacagggtttcaccatgttggccagggtggtctcgaactcctgacctcaagtgatctgcctgcttcggcctcccaagtgctgggattacaggcgtgagccaccgcacctggcctatatccccatttgaaagataagtaaactgaggcttagaggctagctaactgatggctgaactagaaccagcatgcattgatgaggtgggggatgatgactgacccactctagtcagaatacagaacctggcatagagtgggagagcaatcagaatggctgaatacccagcactttgggagtccaagctgggtggatcacttgagcccaggagttcaagaccagcctggacaacatggcgaaactgtttccacaaaaaaatataaaaattagccaggcatggtggcacacaagtgtagtcccagctactcgggaggatgaggtgggatgatcacctgggcctggggaggttgaggatacagtgagctgtgatcacactgctgcactccagcctgggcaacagagtgagaccctgtcttaggaaaaaaaaaaagaatagctgaataaatcaacgaacacaacttcagccttcttcccaccacactgctagtgtaaggcagtgaaaacaaatgagagactaatctgagggtgcacatttcaaactaagaaagcagaactggaagaagggtcctgggaaccaaacatgagggcacagcataatttccccccaatctaatcgggtgcctacttgttttccctcgtgacacaatgaagcatccttcagaaattaagacacctaggtctagagtaactgagaggaagccaaggggattgtttcagctttggagggttctagttctgattaagggtttaaagtggcagagttccactcagtgaagattgatttgacatcactatgtgctcagcatgatgctaggaacacaagagtcacagcaatatggtctgagctctcagggaacttgcaatctagctgaagggacaaaatcagtgcacatctaacagcagcacagagtaaaatcccggagaatgaacacatgccaagctgcacagtgagactcagctacactctacatggctgcctccttgttctacagtcttagcttttatgacaactcctcagagagatcttcctggtccacatcaagtcattccccctgttgttctctctcactgcactctactgtagttagatatttactgcttatctgctacttgtttactatgtctctcaattagaaggtaagctctagtgggaaagagccagaccgtgtttgttttattcaccaatatattcccatgtatcacacatggtagacactcaaaagctacctgttaaatggataatgaatagatggatgggtgtggaaattcacagtaaaaacacaagcgatccagagaggtcagggaaacctttctgaagaagtaggcctttaagaattgggaggatttagcgggtgtggtggctcacgcctgtaatcccagcactttgggaggccgaggtgggtggatcacgaggtcaagagatcgagaccatcctgggcaacgtggtgaaaccctgtctctacgaaaaatacaaaaaaaattagtcaagcatggtggcgcctgcctctagtcccagctactcaggaggctgaggcaggagaatcccttaaacccgggaggtggaggttgcagtaagctgagattgtgccactgcactccagcctggcaacagagtgagactctgtctcaaaaaaaaaaaaaaaaaaaaaaaattgggaagatttggaaagctgcagatttttttttttttttttgagatggagtctcgctctgtcacccaggctggagtgcagtagcgtgatctcagctcactgcaagctccacctcctgggttcatgccattctcctgcctcagcctcccgagtagctgggactacaggcgcccaccaccatgccgggctaatttttttttttttttttttcagtagagacggggtttcaccatgttggtcaggctggtctcgaactcttggcctcgtgatctatccacctcggcctcccaaagtgctgggattacaggcgtgagccactgtgcctggccagctgcagattattctaagcaagagaaaatattcaaaatatttacagagggagtgcctacaaggtacaccaggccctgaaccagaccctaaagctgaccaagactcagctactgccctcaacccctcattgttaggtagagtctcagtcaggcacagcatgtctatagggcagtaaggcaaacggcctaagagagagcacaagaaatataaaggcagatagggcacatagcaatggcaacagttcacagaaggcctggaagttcagggagcaatttggacctaatgtcacagaaaacagggaggttcccaaagcgtccagggagggggaacaatccaagcaagattctaggaaaaggttgctgtagaacagcgctgtccaatagaactttttgtgactatggaactgttctgtatctgcactgtccaagatggtagtcacatatagtaactgagtacctgaggatctgaattttccattttatttaattaatttaaattaaaatagctgcatgtgtttagtatcaaatagctctagcaccttgtgactccaagtgtggtctgcaaaatggctgcacccccatcacgtgcagctgttagcaatgcagaatctcaggccccgccccagacttgctgagtcagaatctgaattgtacctaggtcctctaggtgactcacatgcacattaaaatacaggaaaaacttctagaattgcacattaaaatcacctgggaacttttacaactacagatgtccacctccaccaattaaatcagaatctttgggggacagggcccagacactgatatttctaaaaagtgtcccaggtaattagtatatttccccaaaatttcctgctcttaaaagtcaccttcgggtgacttgttgaaccaccaggcagcactcctactgaattgtaatcttcagagaggtgataaagatttagattttaaaagcaccccaggtgactcctgtggtcaggcacagttgggtaaaatggctctgccagaatggactggatgggggaccggaaacaaacacaattcggtacatttttattaatactgatgaaaggatcgactgagccaatagagccacctgcaataaagaccataaacaaaggctcacagagaggtgtagttcttcactcctaagcctcatccttttctatattgtaaggcttctacaattacaattcgtccacttttataattgatatgtacacttgagcaataattctcaattcccaacccataacccccgaaagctcatgttaagttaatgatgtgtatagtatgcaatgtaaatgctcccttgtaattcaggatatccagtagaataggaatcaggagaccctattttaacaaaagttaagaaactgaactccagtttcttaacttttgtccttttatgcatttctcactctttgactaccacatgccaagcactatgccaggccacagaaatgcaaacacagtaggcattgcactacccaaaaagaaatccccacccagccaaggtgacagataatgtgaatgtagtaagcactgtgagagtgcagggaggatggaatgagctgagtcacaggaagttcaggaaccgcttcccaggaggggtcatgcttgcattaaatctggaggtaaccacaaaatcagtataaaagcatatggttagtttaaaatatcaggtgttcattacaccattctttctacatgcttgaaatctccacaataaatgttggggagaaaaaagatgagatagatgaacctcgagggcattatgttaagtgaaataagtcagtcacaaaaggtcaaaaattgtgtgattctacttatatgaattatctacagtagtcaaattcatagagacataaagtcaaatgaatggtggttgctaggggatatgagggaaggagggaataattattgttcaatagggacagagtttcagtttggaagatggaaaagctctggagatgaatggtggtgacggtgcaaagcaatgggaatgtactttatgctactaaactgtacacttaaaaatagttaaaatggtacattttatgatatgtatattttacaatttttttaaaaagatgaggccaggcgtggtggctcacgcctgtaatcccagcactttgggaggccgaggcgggcagatcacaaggtcaggagatcgagaccatcctggctaacacggtgaaaccctgtctctactaaaaatacaaaaaattagccgggtgtggtggcaggcgcctgtagtcccagctactcaggaggctgaggcagaagaatggcgtgaacctgggaggtggagcttgtggtaagtagagatcgcgccactgcactccagcctgggtgacagagcaagactctgtctaaaaaaaaaaaaaaaaaaaaaaaaagatgagatagatccaaatgtcctgatgtggaaggacacccaagatacatacttcagtgaaaaaagcaagttgcagaatcatgtgtctagtgtaactccagttgcataaagaaggaaaagacaaaggtgcttgtctatgcacagacaacattcggaaggacatccaataaactagaaattaagttttcgtctggagcagggtaggaaataggtcttctaatttcattttttttgagaccaagtctcattctgttgcccaggctggagtgcagtggcgcaatctcagctcactgcagtctccgcctcccaggttcaagagactccgcctctcatgcctcaccttcccaagcaggtgggattacaggcacatgccaccatgcctggctaatttttgtatctgtagtagagacggggtttcaggctgatctcaaactcctgacctcagctgatccacccacctcggcctcccaaggtgctgggattacaggcgtgagccactatgcctggccaggtcttctgatttctatttcaaccacttatgtacagctttacaaacttttatttttatttatttatctttttttgagacggagtctcactctgtcacccaggctagagtgcagaggcatgatctcggctcactgcaacctccgtctcccaggttcaagcgattcacctgcctcagcctctagagtagctgggattacaggcacccaccaccatacccggctaagttttgcatttttagtgacacggggtttcaccatgttggccaggctggtctcgaactcctgacctcaagtgatctgcccacctcagcctcccaaagtgctgggagccactgcgcccagccagttttacaaactttcaaaatgaatatgtattgctttcataattaaagcaaaaaaaaaaaaaagtgtatactttgcctggcagaccatgctgtttacgtgaatatcctcctctctctgggagcacatggggctaagacagtgtctcatttgcctctgtccctccatccagcacccagcagccactcaacaaatgctgactagttgaatggtttgaccatattatatactgctttctttcccaaacatgtggcatgtttcccaaacatgctcagcacattcattctcgctgcccagttgatgaatatgaagaaataaatactacgccatggtggtagccagtaacaatggtccctgtggcttccctcagaggctctcatcaaaagcctttgctgggggaggccaccgtcctgcctaagccttggcaaacaatcttacctcatcatatcccaagatcgctgcatagaaatgatttgtcatgaggatcatgttcttcttcaggatatagggattaacctacagaaacaaatggcaaaaacaaaagtttgaaagaaagaaagaaaaaaacccaaaaagtatgatctttgactcttagctgtcacagactcttagtagaagagagacggccactaacaagtcaagctgccagtccattctcaattccctgatgtgtcaggattctccccaatttgccaaattcttttaggttttgatctcaaattacacaagtcagcttaatgaactgagccccaaccacatgtttagttttgtgctagatcctatgaaccaagtataagaaacagtttcttgattggaggagcacagtccaatgtaggaaaataggcatataaaaaataattatactgcaacatgttgcctcaaatcctattctaaacatgctgagtgataaatgggttttagttttacctgcttgagggagctggtaagggctctctaggaggtaacatttaagtgaaacttggaggaggaggagtttgacagaggagagtgagggggaggagggagagagagcattctagacagagcaaggtgtgcaaaggtgcagaggctggaaagaaaatggcgcagggagggtgtcagggagggtgaataggcaggatcacaagaaagttatgttgagactaggttaggagacatcttaagggccactcaaaagagtttgtcgtgatgaaaaaacagagaaggaagtggtcagaggtgggaagaggagggagagaggcaggactctgagagacatgctgaggaaaaaggggggcctctgaggccatggaaaggagggaagaacaaagcaggggcagctctgaagcaagaagaatgttaaagttaagagatcattttggctgggcagtggttcatgcctgtaatcccagcactttgggaggccaaggcaggcagatcgcttgagcccaggagtttgagaccagcctgggcaacatggcgaaaccccatccctacaaaaaaatacaaaaattagcctggcatagtggtgcatgactgtagtcccggctacttgggaggctgaggtgcatcacttgagcctgggaggccgaggctgcagtgagccaggatcgcgccactgcactccagcctgggcaacagaacaagagcctgtctcaaacaaacaaaaactcagagactgttttagaaatgcaattctggtgagatggttgagagcccagtagaactcctctctcctcttggggaacagcctggcctggaggatcttcagggcccagagtgcagttcgctgaatgccttcaatagggtacaactctgacctccagacagtaacacgctgtaaggcagggtccacgttttattcctcttcaggatcccagcagaaagccagtgcaatgtatagcacagagtaaggactctgactatctgaactgatggttttggaaatagccaaaaggcatttggaactttatgtggagaacaagatttgtgcttaacaactctgacggtgaccatgcccacagtcatctcatttacgaagcacctgtcatgggctgggaggtagatgtgttacagtcactcagactgtaagtgactgtgtgagagactcagactggtgaagtgatgccttgtgtcacacagcaaattcatgataaagctgagatcagcatccaggtcagtctgaatccagagtccacactccttacagtctgccagggttctgcttctgggaggataattttactttgggtcacaaatcaaagactgagtgattttatcctgtggctcataactagtctcggaagaaatgtagaaagggtgatctggatttagactcagaaaacctgggttcaagtgatagttttgctatgtacacaggatgttatcttaagcaagtcaacctgagtccatttcctttttcttttttgagacagagtctcgctctgtcacccaggctggagagcagtggtgtgatcttggctcacggcaacctccgcctcccgggttcacagcattctcctgcctcagcctcccaagtagctgggactacaggtgcccgccaccatgcccagctaattttttctatttttagtacagacggggtttcaccgtgttagccaggatggtctcgatctcctgacctcgtgatccacccgcctcggcctcctaaagtgctgggattacaggcatgagccaccacgcccggcccatttcctttttttttgagacagagtctcgctctcttggccaggctgtagtgcagcggcatgatctcagctcactgcaatctccgcctcccgggttcaggcgattctcctgcctcagcctcccgagcagctgggattacaggcacctgccaccacacctggctaatttttttgtatttttagtagagatggggtttcaccatgttggccaggctggtctcgaactcctgacctcaggcgatcagcccgcctcgacctcctaaagtgctgggattacaggcgtgagccactgcgcccggcccctttcctacacacagggctatttggaagagcacgtgagttagcatgcattcattcattaatttaataatgtatgtatgctgaaagccttggtaaactgcagaatgctctgcaaatgtaaggaattataagtaataacttctggtttgtttacataaaaccaaaaccagttccaatgctttacagccatggataattttcaaaaatgaaaggattgtgaagctcaaggctggaaaatgtagactggatgtaactaggagtgcaaaccatgacctatcccacacaccttcaaccagggctacattagccatccatccttggtgttctcacagctctctgggcatattttctgcctgggtacacacgtggtttagagctgcttatgcacctgtctctcccattagtctgggagctactcaagggtcataggaaccatgtctgattaatctcggcacccccatcatctggtccagagcctaacccagagcaggggctaagacaggcttgctggtaactgaatttttacaagggcctgtgtactacgccatgcatagcatgttctatccaactagtgttttaggggattttcttcttcttcgcctttctttccccctgttgaataccttctgtgtttctggaatttcagaaacatatactgccaaacttctactgtcccatcttccagaaaggggtaaagggaagagtcaagaaacaggccagagctagagttcattccttctgtcatgtgaggatgagactacaactcagacctcctgatacccatacttggaggatctccctactcccacatgagttgttctcctaattgtgttaggaataatcacagccacaaacggatgatatcagaggtgtcaaacagtaaggcaggagcatctctcagaggaaaacattcactgaacctgcctagcagagctagtttatgtcatgtatcacaccattaagctttggagcaggaagggccctcagagattacctagctcaatacccttgaggaaagggtgaactgaaacccagaaagaagagacttattcaagatcacacatcaagttagtataagagccaggattagaacctgatttctgggtaagtgcttttcctactttaccatctgcagggcatttccagagatcatcaacacattcatctgcaaacctcagttcttgctttccagcaaggcccacaaacatacaaacacattttctcctcttgggatacacctgcattctggttggctactgcccaggaaaaacggagtgcaagagtagagttccttactagcaaggctccttgacttcctggtcctatattctaactccagtgacctgtaagctgcctctcccttcacctctagctgagacaatggcaaactgccacagctagaaatgcttttcagatatcatcacccaggctggattagatcatgaaaaggggccttcctggaagagggtggaagtgagatcagtacagacacgtgatctgcaggcaacaggtgagggcaagtgacagcaccttcctcaactaccggactcactcggcagggcccttctagctagtccagcagccaaggggagcaggatattcgctctggtgaatccctgttggattttattccctcatttaagtttttggttgctggtgtgcaggttccccacctctccactgccagatcattctatatggagcactctgcccatgactacacagctgcacccagcagaagagaaactcctcccagatagtgttgggccgttctcttattaaactcatcctttccataatgctttgcttttcataaaaacccatacatacaacaccacaaggaaaaggttccttttatatcagttactcatattttcccatttatttaagccattaaaattcatgcagatattttataagccaccaggattcagtgactggtattactgaatgtttaataataaactaaacagaagaaatcagagggttaaatgatgactgcaattcctgtaatgacttaattaaatttttattgagtacataaactatgatgtcacctctagccaaccacaggcctgctttcccagcatgtcacagggagggagcactcaataggaggcttggctaaatgagcagcaggtctcagctgaaatggggaggggagtgaggctcatgtaacacactcaataaattatccgttcatttttaaacaaagtccatgagttataatatatttgccatgcactttttatgacataataaaaatgttaccttaaggattacttaacacatactacaaatattatagcagaggcaggcacaaggggcaaagaaaacaaacacgagcaggccagggacgggtcctggagtttatgtcccaggggaaacagcatagtatattaaaaagggaatgcaaaaaaaaggaagggatgcaagagttcagggttactaatcggcagattaatgaatgagacaaccaacagagaacacaagtaaggcaataatgaatcttgcagggcacatgtttaattaaagtagcattctcaaggaggaatattagctttaaagagatgccagttcatttgaggccaattcgctgctctctttccccttttcactgttgctgccttaaagatatttatgtgactgcttaacagaggaaccagactatgtggatacagggactgatgggagatcaagttttaactcctccatggactctacaaggcttctagtgatctgctcttggccatcttttttgcctcccctcctcttgcctccccatcttacttcaccctgcagtcagtaaagtatgtgcacagatacatcatgctgtcatctatttcttagtcatactgctgccaggaattcttctcttctttatccactgatggaagggatgctaactccttatcctctaagacttagcacacatattttctctactaagtctgccctctcccccatctacaggtgccccaaagtgattcaagtctggagacgggtcccatcattcattatttaccaagtgccaataactgtgctacaactttacacattagcccacttaaaccttcccaaggactctaagagacaggaactgttactgtctccactttagagaagaggaatctgatgtttgggaaagttaaagctagacagctaggaaatagtggggtcaagataagaatacagagcaatccaactccattgcctacctgtgttggaatagacactggaaggaatgtagctgccccttcctgtgccccacagctcaggctatctgcagaggcagaactaagaaatgctaatgtggtcttgagtaaacacaactcagagattccagttccagtggcagctagagacagccaccagatgggtcatcagtggccggttactaatacatcagatatccctagtagagccaagctccactcctgggaaaacctgaggttgagagtgggtgtaattatggtgggggaatgggaaaacagaagaaagttggtatggaaaacactgatgagcatgaaggtgagaataagctttaaggttactggcttgaagcaaagttgctaacagtagcagactaagaatttgctggaatgaatgaatgacaaaggacagctagagttgctggctgaagcctaaggactatatcaaattcatcataaggcaacaatgcaacacaagattgtaggtcatgttttagtttgctgtagtagacagtaatgccaccaccaatgctttgcagtgccaacgccatgttctacagtcattgtgcggcaacaggctgatgtgcactgaacatcagctagcctatttaaagttcaggttagaaattagcccactgtggaatattttgtgagatacttagaaacagagtaagagtagacagacaagagagacgggggacatggagagaccaaataaaaaagtctacctgttaactcacatgcattacgactgaaagatctattgagggtcttttagcaatgatgacaaaatacaaacaaaactgtgtgtgtgtgtgtgtgtgtgtgtgtgtgtgcgcgcgcgcgcgcgcacgctcaggcacgcatgcatattgagcagttccagaaaaagttgttaataccaagaataaaaagaaaaatattttaaatgaaagacaatttctttttctctttttagaaaataatgtgaacatttaaatagagtatgttcccgttgcgatgaaaggccaacctaaacccagcatgaggaggtccattttaaaatccattttaaacatttcaaacttttaatgtacaagggaagcttgctatgatgacatgctgtttaaaaatattcccttattggctgggcaaggtggcttacgtgtataatccccatgctttgtgaggccaaggcaggtggatcacttgaggccaggagttcaagactagcctggacaaaaaagtgaggtcctgtctctacaacatagtaataataatacaaacccctttcttatttattttgaaaattctagttttgctgcttgggatctacatgttcaagactgcatagcctgataatgtgctgaaaaacaagggacatggttggcagacagaattgcagaaccagcagccctaatttctatatagtcacgaagtacaggagtccttccctcaggcttggaaaatagccaagagagaagagatgtatgtcctcagaaattctagtcatttgtccagttgagaaaacatgagaacacataatattaagtccacaatcatcttcaaaaggagctgatgaggtacactacggttctgggatgatcaaactaccatggcaatttaactttcgtctcttttagggcatttgaataaggggaacattatagctataatctactttggtttctggaagctttttgtagtattccacatgacaagtctcatgcatactcattagagaagccaacacctggcttgaaagagtcgcagtttcaacaacagcactgatggtgcggagtcctaaaggaaataatcctgggtactatctaaaatccgtactgataataatgatgacagtgatggtcgtaacaatgattacacaatgcatttaataatattttcattttattatcttatttgtgcctcacaaccacaaccctgccctcgaggagctcacagccaaaatgctattgttgtcctgattctataaacaaggaaacagaagctcaaaactgttaagtggccaggtgcggtggctcacgcctgtaatctcagcactctgggaggctgaggtgggccgataacctgaggtcgggagttcgagaccagcctggccaacatagtgaaaccccatgtctactaaaatacaaaaaattagctgggcatagtggcgcatacctgtagtcccagctactcaggaggctgaggcgggggaaccattgaacccgagaggcagaagttgcagtgagccaagattgtgccactgcactccagcctggcaactgagcaagactctgtctcaaaaaacaaaaacaaaaacaaaaacaaaaacgttaagtcacttgtagtcaaatcacatcctgcttgtaagtgacagtgctgggacttttaactcagatggtcagtctctaaatctactgtcttttcttttttttgagacggagtcttgctctgtcacccaggctggagtgcagtgggaccatctcggctcactgcaagctccgcctcccgggttcacgccattctcctgcctcagcctcctgagtagctgggactacaggcgcctaccaccatgcccggctaattttttgtatttttagtagagacggggtttcaccgtgttagccagcatggtcttgacctcctgaccttgtgatccgcctgcctcagcctcccaaagtgctgggattgcaggcgtgagccaccgcgcccggccccaatctactgtcttttctaagcgatcacacctttctgcttctgatgagtcatatgagaaatggaagaatcacacaagcacaaagctaaaattgctcatttctgcactttggaaagcaagagtaaaatagactctttttaaatttagaaaaactgtccttaaaaagaagatgagattcgacaaggtcaaatgcacagtattatgtctatatcaaaataaaaaaataacaggatgaagcaagggtctgaccaagtagatgtaatagcatcccagagcaaatctttctcatgaacagataaatcagaaatatgaaaaggtaattattattatctatattaaaggaaaagccatatgcaaaggtcaaaaagttttctcccctcatttattttaatagtcaaaagtctttgtcttaccaaccgtacttaagaatgaacatggagaaaccagagaggtttcaagaaagaatgtcagatatatatggttacaatgggttggcactggtcacaggccagggcgttcaagattctatggccaagagaaacacccagaggctattccatggattggtcaggttgcctccatcatctgcctcaatgggtcagtagatcttagaagtactgtgacactgaggtttctctctctgcatttcttccttatgttcaggacctactctttcccatttccacgagttggcaggctgttgatcctagaatgctgtcctctcatcacagagatgggcacatagctgaagcttagctaatctgactcttgcttctgagagtacaaacaaccaaatataaaaggaagctacagttggatcacccttggcagggcacagtggctcatgcctgtaatcctagcactttggaaggccatggcaggagaactgcttgaggccaagaattaaagaccaacctggccaacacagcaagacctcatttctaaaaaataaataaataaaatagtaaagttgggtcaccccaaagagactatacataagttcctattgctaagatcccttagctgccctgtatctttccttcctgagctctgttgttaaactctccattccatgagccttagttaccttccaataaatcctttgtttgcttaaattagctaaagtcagcctcccaagtagctgggattacaggcacgcaccaccacacccagctaatttttttttctttttctttttgagacgcagtcttgcactcttgcccaggctggagtgccgtggcgccatctctgctcactgcaagctctgcctcccaggttcacgccattctcctgcctcagcctccagagtagctgggactacaggtgcccaccaccacgcccagctaatttgttgtatttttagtagagacggggtttcaccgtgttagccaggatggtctcgatctcctgaccttgtgatctgcccgccttggcctcccaaagtgctgggattacaggcgtgagccaccgcacctggccgagcaagataattccatttacacccactaggatggctataatttaaaaagaaaagaaaaataagtattggcaaggatgtagaaaaactgaaaccctcatgcattgttgaagaaaatgtaaaatggtacagccactgtggaaaacagtttggcggtttctcaaaaggctgaacatagaactaccatatagcccagcaatcccattcctaactatatgtccaaaagaattgaaagcgggaattggaactgatatatttgtacaccaattttcatagtagtatcatttatgatagccaaaaggtggaaacaacccaagtgtccaatgacagggataaacaaaatgtggtacacacataccaagggatattattcagccataaaaaggcataaaattttgatatatgctataacatggatggaccttaaaaatgcactcataaatgcattatgcttaatgaaataagtcagacatggaaggacaaatattgtataatttgatttatatgaggtacttaggtaccttcagagacagaaagaagaatagtctacctggggctgatgggaggaagaaagggaaaattattatttaatgggcacagagtttttgttggggataatgaaaatgttttgggtatagataatgaaaattgttacacaacactgtgaatgtacttaatgccactgaattgagcatttatgaatggttaaaatgataaatattatgtatgtatattttaccacaataaaggaaatcccagttacaaacagttcttctcagacaggcatttcaatctgtgacttaaccatgtgtgtattaaagcctctcttaggacacttatccatttggcacagtggtatcatgagctaactgatgttcctcaccagactataaacggtcttggtacagaattctacgttgcattgtacatgtttgataagcacgtattgagtaactgctgtattctactgtggtatatgctggaggtaaaaaaatcaataaaacacagtacttgtcctcaagaagtttacaatctcacgtgggagacacacctagcacgttgtatgtacaaaacggtaatggtatagggactgaaaggcttgagagaagaggcaacatttattacagtgggtattaaagggtcaacaggtatgttcagacagaaagaatggtatgtgtaaaggcacagggaggtgaacaagtacagcattttcaaagggaagtttgtaaaaaaaaaaacaaaaaaacacacacaaaaaaaacaaaaaaacacagaagctgctcatggtggcaagaatcagaaggtggagctggaagggcagtttgtgtgagattgtaaatggccctgaacgccagccacatgaaagaaagaacaaggaaggggtttaagcacagggaaattgcatggacagatttattttcaaaaagtaaccctagaagtacagatcacaaagttgggggaaggtccagaggcaggaaaaccagaggaggctgctacaatggtgtagatgagagtctgtaaggaactgaaacaatgtgaagtgacaacacgaacaaagaggaaggcatgctttcaagagaaatgactacagccagagcaacgggatttgattatcgagtagatgaggaggaggaaaggggaggccatgacttgcatgtaatcagacctcactgaagaaagtggagagaacagaaagatgaaaacggaatgcaagttatatgcaatcatacactgatgactttctgaccctggcagtgccaagcgcagacaaccagtcttgtatgattttagcaatcaccatgcccttcatgtctcctatgttgtggtaatggaaaatcttacttggataagatgtaatatgagcaagatgtgtatttagtttgagcccggcaggcgtctccagtggagcacaggcataacacaccagggcctaggagcctgagccccttttccagtaatttgttcactacatgtaggtcggtatcattactccgggccctctgcattctgactgcagccatgaggtctgattaccgtcagcaagaagacgctgacacactcaggtttccagagacacttggaggctgctaattgcaccctgagcctcatgactgcatttatgagcgcagaaaagctgcaggcactacttggcttttttaattattttctattaaatttaggcagactgggtacagtggaaaactacaggatgcttgttccacatcactaccaaccatgtcaactgcacagacacaaaaggcaaacaggtgaatatagatcaacaagttggtcagttctttgctaatagagctgagccactgtcacttgtcatggatgctgaggccctgaacaacctagaggatctaaaggcaacactgagatcactgacccgagtcctttcccagcgatcctaaaatagatatcatattgcccagatggcaacattttctcagaggacccaaaatttagccccttactgatcttgaggttcctgacccttcatccaacagccctgccttcttcttctccacagcaatgaagagtgaaaggggcggggtcaccctaatgaactgaatcacaggagttaactgctaactccacctgggcacaatgggtcagaccaaagtctaaagctcaaaacagtaaagcagacatttacattgtttcacacaggtcacagaatgtttgtctttcactgctgtgtcctaactgctcactgttcagagctgtacaattgccaaaatactgacccaatggttatctgagaaagaggctgttccctgctgaagacatgaggaagcaaaggctcagaaaggtcaagtgactcacccaattatcacttggctaataaatggtcaagaggttcacagagacaaggtcttctggctcctagtccaagtttttttgtttgttttaaggctcaaacagaattgccactcagtggatagtttgtacattcctgtagaagcatcctgggaatggctgagcctggatcccaggtagaagccatatgatcattcttacttaagtagtgaggtggtcaaggttgaggccaagagtgaggttcagatatcccttaaaatggaattgacagagccgggtgcagtggctcatgcctctgtaatcccaccactttgggaggttaaggcaggcagatcacctgaggtcaggagtttgagaccagcctggccaacatggtgaaaccccttctttactaaaaatacaaaaattagctgggcatggtggtgggtgcctgtagtcccagctactagggaggctgaggcaggagaattgcttgaaccaggaggcaaagattgcagtgaggtgagattacgccactgcaatccagccggggcaacagaacaagactttgtctcacaaaaaaaggaaaaaaaaaaaaaaaagcatggaactgacacagcctgtgagttctgagagtgactccatctttatagggtaattctcttttgtcctcttttctcagtaaaatgttcttagaaaggtattttatccaaaggaaagagacaaactcagttagaatgctgtatgttaaagagatgatctctttggtgttctgtatttaagtcccaactcagacctaggaaacgcactgaaatctaagtaaattttgggccccaacagccctgtttccccacctggtgagtctgaaagattaatcactctgagcctcagtttttccatcacaactatgcaaaaccacctttcctttttccttttcatattaacagatgaaaatgcctaacagtaagtaaattagtagtggcaaacatctatttcactctcaggcattgtttaaagaacctcacatgtgataactcatttatccctcacaatgctacaagcgatgtaaggtgggtattacagttatgtctattttacggagagaaaactgaggcatagaaaggaaacaggcatagagaccttgcccaaggtcacatggctagggcaggatttgagtccaaactggcttcagtatgtgagcactctcaactactctgtgatactgcattggaaaggaggttataaactcaacccaatcccccacttggagatgagagcctggaagtctctgaagcttctctcaggaccttggggctcacctactctcctgcctcatcctcccattacactcagccctgccctgggataactcctggaagaagcctgcagtgaacacaaaacaaaaaagcaagtgaactcatatctttctcgttcgtctgtttcgtgtggaagtgaatccaggaaagattcaacttcctttctcagcataaactagattgtaagccctgtaagatcacttatctctggtatattatctaccaaccacattcagggattagcatgtggcgagagacaaaaatgttccttgaataaatgaatgaaacaattcttaataaaaccatacaaattaataatgctactggatctagaggaaatacattcaatattgccttcatcaaatgtattcagcactacccaggcatcaagcactgttttaggagctgaggctacagcagtaaacaagagacaattcccgaactccgggagtttaggatgattagtcaggctgctgaatgatttgcagaatgaatctgagatgaagagagtcaagaggcaggaggaccagtgaagaagcagccgacagtgagtttaggtgagaggtcaggactggatctgagcatcagtaggacagttgaggccctgatagtggttgttttaaagaagggctccttatagttcctcctgctcctttgagaaccaggcacgtcacattgatggcaaggatcactgacattcagaaagaccagctaaagagaggacaatgaacatggaaaaacaagtccctccactctagctgggccccttcagctccaaccaaccccacagggccattcactcagcattttgggggaaacaaagtgagaaaagagtgttacagctgcctcatcaatggatccagaaatactcatggcacacccagggcagctgaaagaaacatctgtctctactgtatcctaggtctgacctcagagcctccagaacttttttacatagccccacccagatcctggcggagctactgccctctggtggtacccaatgcaggggttaagcccacaggagaaaagagtcttgtggtaggacatggagtgagaggcatagtcaaccccaagagctcgtcacagtgcctgtatgtcttactactgcaaccactgctttttccaaagacgctatttacagaaaactctggttaaaatgcaagagttatctgggaccattaaaacagatcctgttggcaacccttaacgatttggcatgaatttaatcaggtaaactgcagtgtaagtatagaattgattctaagaagatagggttaggaatagactctgtgagttcactcactcattcaccattcaaccaatattggatggaggcttaccatgtgctaagcactgtgctagacactggaatgctgaccttaagagaaaaggatcaggaggtctttgattggaggcttttcccagcaacacaaaatgcagggtgtgtgtagtggctctagagaacagcaaagatgatagtatcaagtaacgaaaagagcaacagaatcaatcaagagaagtgagttttagtctctgctactaccgctactatatgacactgaccaagcctttttcctgaccaggactgagtgtcctcacttggaaagggttgaattaggatcatctttgtggctgtcaagcttctaggagcttggcggccactgaaatgattaggagatggcataaaataaaaacactgactgcttggcaattctgaccagctagggctagccctgggtggggcttcctgccatcagccagggcaatctaaaattcctttacatagttcctgaggatcatcaccaagtgagattcttctgacatccatacccaaccacttcatcagacgagatacccctagtacgttatgaaccccacatttgtccccaactaccctagtctcttctggtccctttgaactgaggctattagggacggagccagttcttccagtgctacagggcaagagaggcttggagaaaagtagaaagttttgcaaactgtgttcactcttggaaattctaccctgggctggaaaatttttatctcatggattttttttcaagcaggaaaggcccttagaaataacctggtccaggctctgcattggagcctgctggttaattgtggaactaagtctaactccactcttgtagctccaagattggtgagtgtttttcagttctcccactgtccttctagagggaggctcttctctggcagccaactcaccttgggacctaaagcacaggagacgataaacaccttctgtctttgaaggagaaggagtatagccacaaacacctatcgaaaatgccaaagacaacaaggttcatttgaaatctgaagaatcttagcaaaacggtatgggacagggatgaaaagaagagcaggagacagaagcctgctcagcgcttaacaggaatcatctcctacttgccccataaccatacacataccacaagccagctgattcctaaccccagcagctaaactgcccaaggcctaggaaagggggcaacacacacagtttacaccttttattattctgatcaaaatttctctcctgggagcagaaaggggtcaaaagtccaacaccaaaaatatatatctttataagtcatgggcaaagaagtattacagcagacagttatttaaaaaaaaaaaaaaaagctacggtgaacagagcagagtaggaggtgtgagaaaactcactccaagtaatttattcactgggaaccacaaagggctttcccaagaacagcaaaaacaccattaatttctccagtaccctcctttcaaagggctccaaacacttcacacatatcgttttaaattgtcctcaaaggctccaaaataaggggttactatttccccaggcacagatggagaaactaaagcatttatgcccaccctgctctgcccaagtcatcctaaaagattcagccaacatcaactgagtgcctgctatgtgccttactcatgccaggcagaacaggagacggatgaaagataggatctttgtcctccagaaagccagaatccagtgtggtgtcacagatgcacctataaatcccttcaagatatgacagcttatgctaggtgctattgaaaatgtccaaatacagcatcctgatagctcccatttatcaagtacttaatatgtgccaaacactgtgctaagccatattgtttaagtcacataactgtgcgtgacttaccttatagaggatggaatggagacaatgagaggtaaagagacttgcctaggatctcaaagcaacattgtggcagagcagagattagaacctatgtctgtctggctccaaagaccacatgacaggaaaagaactgtttggaaaactgggcaccggcctctcaactttctagcactgaatgccacactttagaggcgaacagcagaacacacaggggccctcactagattttgggggaatggcctgtttcctgggcccagaattgtatgtgcatgtactaactgggattctccatcatggggacatctgaagccaaaggtaggtgtgtcttccaaaagggaacagagctctctctgggtaaaggagagctgaaaggtcctgagctcttcttgctcctttggtaagtactgaaaatggaacaggactagaaggtatgggattcccatgctggctttaacagaaggttcacagcctgcaggaaggcatggtggctgcagtgcacatgcagtacggtatccttttctcagagccagagtagaactcttgctggggaaggagtcctctgctggagaagggcctggcttagtgacagctctgcagagctcacctggtggcagcaagtgctgcctcttttgccaaagccccattttggaggccaaggaagaaaatgccagacttggagaaagaagagctccccacaccagacaggttacaaagaaaatggtcagtcctggggaatgcctaggtcttagcaagggctgggctaataaatcgctctattttaagcccacaggacataagacagatgcgagaaagagaatgtcctccaaactctgagagcaaagttgagcctggaaataggaaacctaatccccagcctagcattcttcccacttacctcaaggcatccttctgtaatcgtttcatatcttaatttcaacctaataaaacaacaacaagaacaaaaaccctttgatggagccaggtacttctgtgtattattatctcatttaacataagtgacttgtgcttctatcaatggatcagttagtccattagttcactcataattacttatattctacctatttccaaaaaaaaaaggttcaaattggattacaacaaaaggcacatgttatggccaaaagagccaatttttttttttgagcaaagattttgaaatccgtcagctctgggcttgtgacttactatggcggccacagccaagtcctttaagttttctgctccttggttctcctcagttgtaatatggggacactcccaactctatcacaaggtaatttgtaaggattaaatgagatgatgtctgtaaaattcctggcacagagtttggcccatagtatgcaccgcaaccaaaataaaagtaaaagaaaagacttaagtaataaagtctgtggggggcgggagaagaaaggggataatgaatacttacatcaaaatatctaaataagggaagcgctgtactttttggcagttgtggcaaaaggaaagcgggactgctataccattctcattgtttaataaagagaagcatggaaattcatcaggacaaagaaagttcttaattctcaatgcagaagggcacataaatacacgagtgactgtgtatgttacacacatacacatgcttataccatctctctctccaacaggaacagggcaaacggctctccagagtcctgctgccccctgacaccaaactactgcggtgtacagagaagtacttcaagagttaaaacatttttgtgccaatattttaagagtgcagaaggttccaaattacatgtaaaataaacaatgccagactgtgaaaactcttggctgcaacgttctctgatgttaacaagagtttctttattactgtaacctttcagaagtgaataaaaattatttctctgccctagttttgccctccagtaaaagtgaagagagcagtgaccatggaaagagctgtacaatgacctctcctgaaggccgggggctgggaagggggcagtttagaacacaaagccttccatatatgcttctaggttaaaggctagaaatttagtttgtgctgtgctgatcatattgtaaaattttacattcctaatacttttatgtaaccaaaacccttagagcgacaagaaggcattttcaagagcccaacctgagctggtgctatggagaaaacccaaatctggaccatgacccctcaactactcagtgaacccccttactcagaaaccgagtctgaagtgtccttaacaaagaaggaagaagtactgtgtgtgaccagtacttaagacaaaacatgttactactcagatccttaagtgtggatgagtctgtaaatatcagacacacacaaggatctcaaaatggagctagtctggataaagagaatctgcatttaccattgcaggagaagtaagaatgtcaccaaacaaagccaaacattgtttgtcttctcataccaactcggtgcctttatccacactgttcctctgcctggcattctcttcttgtctagcaaacacctacttatctgaaaagatttaactcaaatgtcatctattcccagcctgtctcgagactctgggcattctcagcaatttaaaaacattataatttcttaatattgtaattatctgtttatgtttatcttctcctactagactagggagtcatggaaaatgtcttaatcatccttgtatctccagtgcttttagcacagtacctggaagctaacaggccacaataaaatggatggatagatgggtaaaactttgtttgtgtctgggaacagaaatcagacagagagtgatgaactgctaaaaaaacagaacacaagctctgggacttaacacaaggctagcttttcagacttccacagagttgcagaatgttaagtctggaagagaatgtagaaatcatctaactctcctccccagagaggtgatgtgatttgacttactcaggcttacccgaagagtggccaggccaggcagaactcgttccattatgccacactgtcccttcttactactgtctaaaattgtcggtaaaataagtaatgattaaggtcacatatctaatttcattataaacatatctaatttcattataactaatttcattataactaacacatatctaatttcattataaacaaatgaacaatggaaatcatctaggaattcaaacaacttgataaaagacacaatatctgaattcttcaaaaagtttacatagtgtcaccatatgacccagcagttccactcctaggtatacccctcaagaaagctgaaaacttatgttcagacataaacttatatatgaatgttcacagaagcattattcacaaaagctaaaaagtggaaagtggaaagactaaatgtctattaactgattaatagatttttaaaacatggtatatctacacaacagactatcccaaaaaggaatgatgtcggtcgggggagttgagcaaaaaataaataaataaaaagaagaaaaaagacaaaagaaggaatgaagtactgaaaatatgccacaacatgactgaactttgaaaacattctgctaagtgaaagaagccaaacataaaatactgcatattatatgatcctatttatatgaaatgtcccaaataggtcaatccatagaaacagaatgtagaatagtggtttccaggggctaggggtaaggggaacgggtgtgactgctaatgggcacaggatttctatctgaggtaattaaaatattctggaatagtggtgatgggtacataatgctgcaaatttactaaaaagcaaatttacatgttatgggatataaattatatctctatttttaaaaacagaaaaatggaatatctgccctctagaagctaactaactggagaagctaggaccaacatataagatgcctggctaggcgtggtggcttatgcccagcactttgggatgccaaggtgggaggatcacttgagcacagaagtccaagatcagtgtgggcagcacggagagaacccatctctacaaaaaaacccacaaaaacaaaaacctaagatgcttatggactgaaaggttcaatgctacaatacaagtggatactgtggaagttagaggaagaaagaaacaacacttgggttaaaaatcttaatgccaatgctagagccatagtttttagtttcgtacagagtagtaattaaaagcacaggctctagagtccagaaggtttgggttccaatccaggctcccatatttactgtgtaagtctaattaaattgcctaacagtggtaggtaggctgaatttggtctcctaaaagatatccatgtcccagttcctggaacctgtgcgtgttaccttatatggcaaaaaaggattttgcagctgtgatcaaattaagacacttgagatggggagggaatcctggattacccagttgagccctaaatgccatcacacatatccttccttttaagagagaggcggaaggaacttaggctcagatagaagaaaaggcaacatgactacagaggcagaaattgcagtgatgcagccacaagtcaaggaacatcagcagccaccaagagctggaaggggcaagagtctcccctagaacctccagaagaagcacagccctgccgacaccttaatttcagccccatgaaactgatttctggcctccggtactgtaagagaataaatttttgttgttttaaaccaccaagtttgtggtaatctgctgtaactgctatgggaaactatctctgagccttagtttcctcatctgtaaaatgaggctagaaatgttactaatctcacaggtaagactgttgcaaaatgttataaaattcaaatggtgcttgtaaagtgcatgaaaaaaagaaagtgctcaataaatgttagctattactattggggaactctgcttctgaattatgctgaaatcctcaagtttcacatgtcgttagcccatgcctagaccctgctcctcttagcgaggagaacagtaacagtggcaacaaagacacccgagttctactcttcagtgtttctaatttgtacgcagctcttccagagccaatttcccaatcatctaaatgatataattagtttaggagcagtggttctcaaactagagagctggtgaaaagacagactgttgggtcccaccccagttttcagaagatcaagggtatgccctagagctagcattctttttttttttttttgagacagagtcttgctctgtcgcccaggctagagtgcaaatgcacagtctaggctcactgcaacctccacctcccaggttcaagtgattctcctgcctcagcctcccaagtagctgggactacaggtgcatgccatcacaccaggctaatttttgtatttttagtagagatggggtttcaccatgttggccaggctggtctcaaacccctgacctcatgatccactcgcctcggcctcccaaagtgctaggattacaggcttaagccaccacatctggcctgagctagcatccctaacgagttcccaagcgatgctgaggctgctggtctggggaccacacttttagatctctggatcagattatttcagggttcctttccagtttaaacagtctaagattccccagtaacatccaacagatgcagcactcaagtaataaacactgctgtaccatgctgaaatagccttaaaactaagttctttcctaagtaagagtgggaggccttggaggctgagtatgaagtacatggtaaagactagttttaacttctgaactcagcagattgagaaatctaaagcaatggtggaaacaggaagagactgtccccttatctaacatgttggccccattttaatttatcttaatcccacctttctgccttttcaccagacccctccccgtcacggtctcctctagaaacacatctaggtgtctcctgaattcatttattggctttgccgcacacagtataataccgcctttgttagtctcctggcccggccccttcaagcacggtgttcagtctcggtgttcctctacccttaaaaaaaacacacaaccaaggagtctctgaaaaataattgtaaaatcaactaaggcaaattcagatgatgtagagacactcagactctaaacgatggaaaaagaaacaaattcagaacattgtcagcattctcatgtcttttttttcccccttaatctctattagtcctgttgagtaggaagtctctgccgtattggattagaaattgagtaaaagaggcctcaggcttgggagtgcactgaagaaataaatggaatgcctttagattcaagaaaagctgtcctcttggtctttggcagtccttggtaataagacaggagaaaaggtttctttctttcaattggaaggtaccatggtatagtaaagaggacactggactggaaattggtgtaatctggccttggtcctcattctgctattctctagctgtatgaccttggccaaatcaatgaacttttctgggcatccatttcctcaccacagaaatgagagggtagaaccttaaccagaaatatgtattagaaatcttttggggccgggcacgggggctcatgcctgtaatcccagcactttgggaggccgagcgggtggatcacttaaggtcaggagtttgagacccacctggccaacatgctgaaaccccgtctctactaaatgtaaaaaatcagcctggcatggtggcatgagcctgtagtcccagctacttgggaggctgaagcagaagaatcgcttgaacccgggaggtggaggttgcagtgagctgagaccacaccacacaacactgaactccagaccgggcgagaaagcaagactccgtctcaaaagaaaaaaaaaaaaaaaaaaaaaaaaaaaaaaaaaaaaatatatatatatatatggagagatttttcaaaatgcatatacctgagcctcttcacagactcagaaccgctgaatagagaacctctgaggtacccagtctgacattccaaggttcatccatcctataaagcagattaagtgtataaccaggcttaaatgagagccagggaacccatgaggcagggcagagaaaaaccggacctttttcaaagggggagggtagttagagaaattgaatccaagtgtaatcagagaagatcattcttcagtcagtatttggaatacagggctagccagatgctaacaaaagaagcaagtatttatgttcatccaacacatatttgagtagtgactacggtaggcatgtggtttaagacaccagaaatccaagaatccttatcccatctaacaggagtgacctacataaaccatgagcacaccatggtaagttcagagaagggagtggccagatatatgaacattattggtgaatactggaaaaagcttcttggaggaggtgttatccagcttgtgtcttatagtgccatgagcagacaggggagaagaccagatcagacggaatagcataaacaaaagcctagaggcataaaagaacacagcacacttacggcaccagtgaaagtctggcatgagaagaatatgtatttgtgtgcatgcacttgaacttttttggagggaaggggtatgatttgttgcagattaaactagaagaatgggctggagccagaacatgaatacttcttttctctccaattttttgctttgaagaatttcaaagaatttttaaaggatgtaagagtaatacaacaaaaactcatataagttgttttgagatctgcaacttcaaatggttcagcaaaagaaaagggtgtgtatatgtatgggtagagataaagcaaatgttgcaaaagattcagcattttgcacaatcttagatgcacaatttttttttgcaacatttgtttatctctatccatacatctacacatccttttcttttgctgaaccatttgaagttccagatatcaaaacattttacccctaaatacttcaatatgtatctgctaagaacaagcacgttctcctatgtaactacaagggttctatatgcatccttacccactctaataggagggatctatataaaccaataattacagcacatcatggtaagttctatctctgaagttggtgtagtgctgcagtaacgcagagtccgatgtgccactcaggacaggactggcaccctgactgtatgcacctatgcatctgaccagttgtaaaactgcctgaggcacctactcctcgaactcttgctacctcttaaggcctaggggtaggaaacatgtgtaaagaaaggcatgtatctaccagacgtacatgttcagtaggaccctgcttaaattcgtaagccaatcccaaaatggaattactctgacttcttagaatttagccttctctcccctaataactgactatccactccaacagctcaggccattttagaaactttcaaaagaacaactggtatctgagaacatgtattcttattttcatggcctcaagcccaagggactgtcctttagttacactcacacttttttccccccacccaagctggagtgtaacactgtgatcacagctcactgcaacatcaaactccctggcccaagtgatcctcccacctcagcctcccacagagctgagaccacaggcatgtgccaccataaccggctaattttatttttgtaaagatggggtctccctacattgtccaggctaactataccttttaatgtgctccttgtctttaaaaacaatacctttggcagtgagttttaattctgacctagagatgcaaaacagtaaaatttttatatcgtaaaatagaagaggtctgaaaatttttgtagggaaagagaggcgatttggtgacaggtggtgattacagaggcctgaaaggaaattttcagaaaaactaaagcctcctaaaatgtaatgcctttgttagtttagaaagataaaataccagccgggggtggtggtggctcatgcctgtaatcccagcactttggaaggccgagaagggcggatcacctgaggtcaggagttcgagaccagtcgggctaacatggtgaaaccctgtctaaaattacaaacattagccgggtatggtgcacgcctgtaatcccagctactcaggaggctgaggcagaagaatcgctggaacccaggaggcagaggttgcagtgagccaaggtcgcgccactgtactccagtctgggtgacagagagagactccgtcaaaaaaaaaaaaaaaaaaaagaaagaaagaaagaaagaaaataaacataatataccctatgtataacctggggtttttaaaaaatcaagtaattccattagaagatggaaaagtatgggaaaaaggaactgaacagttgatggtgggggaaacgatttatttccttttcttccaatatttaagactaacacagcaaacaaatatcctcagaataaaaaacggtatctccctgccccactttttccagtactcattctgggcctgcaggactggcttccttcattcttcagatagttactgggcacctattcaggaaaggggcaataacaggcactttggagacagatgtacgtgatcctgcaccacaggaattcacctggaagacagtcaacataagtgaataacagtgatacaaaatagaaagagtaagagctggaagaagggtagatataaatcattaaggtacttccttaggggaaactgggattggcttccagttagctgtggaaggatgtgaaggaattgaggctggggtgttagggcaatctaggtgtatgcatggagtgagcaaagacacaagacagaaatagcaaggaattcagcttggctggagtgaagggtatgtgaagcaaggatggaatgtgatgttcactgagtgcttactaagtgccaggcacatgtgctagtaggtttcacatatttaaggttcaagaagaactagaggaaatgagtttggagaggtggtctggagtgtgatcgtagaggaccttacaaagcaaaatggtggttctgagaagcaaggcagaattacacaagagtcaagttcagcccacagttcctccatttttcctaggccctctgcatcatcccatcaagcagctctgctagagagtgagcaggggaccatgaggtgacagaaggtgcattcttattccagaagtctcactgaggcaacaggcatgccagggaccgctgataagggtaaactgtaatttctcaactacagcccactcccatcccttcccatctctgtcttggaaagcttgagcctgctcattgtgagccacaaggtggagatgtctggcagggcagaactgagaggaagtcgtttagccagcctaaggttaccattaacactttgagccactgccgtgagctaatttttatgtttgttttttaagtttggttgaaatgtcacaaatggaaaaattaagtaaagcgccctggttagccacaagactggacacacctggctgcaaacccagcaaaagaaacttacttcattagtaggagaggcagagagtgaaatttacatctgaaatctgcctgcaccaggagaaagtgctgaggccaaaggcgctgtctgtttttacagctgtgtcaagacttagttctttactcttaccaacactcaggagtgcggcaagggcccaaggaaaaatggtctccaagctcttcagctgcaactcagctcacaaagatttttaagaagcagttaatgaaataaaactagaccagatgaggtgatataatgaactttatttccacagctaatttataagtttaaatcccaaataatgtttttttaagtcagaacactctaaattattgatgtgatttttgtaacctcaaatttaacacctgctttttgtaccagcttcacgatgatatatgagtctgctccatttttcacaatagttgggctccaaaaagttggtgaaaagcaaatttttgtaaaataaaaaatttcccaccaaatcagaatagaattctaatttcaaaggagtttttgatgcaaatttattattcatcactaactcgaaagtggctctcttatttcttgatcttccacacaccaatccactcaaagcaatcacctctaagtttttggcatgagaaaaatcactactacattgattggttttataaattctacattttatatgttttcttacagaggtacacctgggatgccaaataacacagagatagatttgcaaattaccaccttcaaaccatagattttcaagctgaaaaaaagctgaaaacttggggctcatgtagttaggcctcccctgtccccacctttcttttaatacagaaactgaagcacagaagaggaaagatttgccagtcagggtgagaaccaggccagactggctctacactgcctattacttctccctagccacgtgtcccatttataggttgtacacacacggaagactgagatcccctcaaacacacacatgcactcacactcatccatgcatgcactcacaacccagtgattaatatacaattgtcttgcctatataaggcatgtctatttatgccatgaggttagaaagaaggtatcaagtcaactatagcagaaagcagtaatagtaattccccaactcttccaaatctctattattttaaaaccatcatcctttagttatagtctttgtaactaaaccggaatttgggcacttctcttcatgaaggcaatttaagagcctgtattgggggaccacctaaaaccttgctattgtcccctaccccaccctgcgtcactagcaacatccgcatcacctggaagcttttcagaactgtagattttctcacccctgtcctgaaacttactgaatcagaatctgtattttaacaagatcctcaggtgaaccataggcacattaaagtatgagaaacgctgatctaaaacactcccttatggggcagcaccctatctacaacaatccaaatagaaaaaacggctggataaaatgcgataggggaaaaattccccaattcctgcaggactgcactgatatacacttggatcagagactaataaagcaggtatgatttatctaataaatgttagcttaaaaaagaattccaaaggctggtattcaatatattcatttatttgacaattatttattcatttgacaattattcaatgtttactgcataagcaaaaaactgaataagacggttttctgcttttataaaacttacagttaagtagaagggacactgcataagaagtaacatgggagaaggctcaagtgttgacaactgtgatgaagagagatggaggtccagaaggaaattcaactgtggcgagaggcaactaaaaggttcctgcagtccaggagtcagcaacctatggctcattaagctattcaggatagagacagctgtggctcatatggctagtgagacaacttccaacagagtttagtcaacaatgataagaagaacagtttcactacaggaagagctactgcgcaactgcctggcagtcagccagggctttggctgaccaggaggtatctctggccatcattaaataggactgagactgccaacaccaccttatgtccactgtgcactgctacagagttgggtggtaagtacttgagggcatgtgggaacattcagctggatgaataccttaaaggctgccgatctcactctgggcagctgtgatattgtgaaatatatagttggtcttcaactcccttcctggcatacaactcctaaaatctttggcctttccaaagtggtgtcattttgtatgctaatgattggtggctggcgcacttaggtagcttcagggtaggggctggtcactgaaaaaccaagggaggattagaaggttaggactttctgtcccatctcccaacctccaaggagggcagagaggctgactgatttccaatggccagtggtttaatcagttgtgcctacataatgcagcttccataaaacccttaaaaggactgggtttggggcacttccagatagctgaacaggtggaggtttctggacagctgcacaccaggaaaggtatggaatctcctcaccccttcccccatcttgtcctatgcatctcttcatctgtatcccttgcaatatcctttataataaaccggtaatgtaataagtgtttccctgagttctgtgagccgctccagcaaattaattgaaccaaagaaaggggtggggaaccccaatttataatcggttggccagaagcacaggtaaaacagcctggagcttgcaattggtgtggcaagttgggggcagtcttgtgggcagagccctcaacctgtgggatctgacactatctccgagtacacaatgttggaattgaattgggttagaggacacccacctggtgacctctctccagaattgactgcctgtttgctgtgtggggagaaactcccacaaatgtgtcacagaaaccttctgtgtaattgtaattgagtgagagagctgaaaaaatactttttttctctatattacacagcagctacgacagaaagaaagcaaaaaatgaaaaaggaaccaaaaaggatgattacaaagatagctctcaggcgaaggatacgcatcaactcaaaaatggttacttttctccttccttgaaggtaagaaaaaataacataaaaaataaaaaaggttacttctggggagttagactggggggaaaaaagacacttgttttttacactcaatactttttactctttgatttctattctatgagcatatgtaacttttataatatgtttatttctcagtccacagggagaactttgccctgtaatgaaagaaaccaaattaacccatttcatgacccagtcatggttctactttggatgctcccaagctgggaggcaatgaaatgcttcccagtaacagggaactacaagctactaaaacgtgatctagatacacaaaatacacaacataaacaaaagaagatactagtgggaggtgaagccagctgggcttctgggtcgggtggatacttgcaccaatcagtgctctgtgtctagctagaggattgtaaatgcaccaatcagcattctgtaaaaacgcaccaatcagcgctctgtgtctagctacaggattgtaaatgcaccaatcagcactctgtaaaaacgcaccaatcagcactctgtaaaatggaccaatcagcagacatgggcagggacaaataagggaataaaagctggccaccctagccagcagtggcaacccgctcaggtcccccttccacactgtggaagctttgttctttcggtcttcaccataaatcttgctgctgctcactctttgggtccgcaccacctttaagagctggtaacacttgctgtgaaggtctgcggcttcattcttgaagtcagcgagaccacgaacccactggaaggaagaaactccggacacaccatctttaagagctgtaacactcacagcgaaggtctgcggcttcattcttgaagtcgcgagaccaagaacccaccacaaggaaccaactccggacacactatgatctgtataaccagctatattctagtgttttggtttcatttttctattgtcattacatcccatgtgacatatatatatatataatatattcccctttctcaggttaattattaaatgtactaatgtacattttcaggaggtatcttaccagactcttctaggttgccagtgatcaaggagcttgagtttcagttcctgaagacagtgcaggccccataccagggcctcccatcagaactaatttatagaaggactggttcaaatattgaactggtgtcaaaggtatagtatccttaactggattatcatttgattccctccattcaccaaatccatccctcctatcaccacgatttgggctttacaatcccatctccatacaggatgacttcacactgacaaatcactataatgtgtacaaacacataaagtatctgtggagtattagtttccacagaggcagaaaaagtgactttagcggaactgccacttgatattaggcagcatttcacagaaatctaaaagcagggccattttacaacagataaaactccaaactcaaacccttctctggaattgtccaggacaagcatctgacagcactcacttacccccatgactctgccgcgctgctgaacatcctcccacataaaatgaactatgatacgacacatgtacttcccactccggccttcctgcttcattcggactagacacatcctgggtgggaagaagacaaaaaaagtcttggctgtttgcatttttcacatcacacatttccactgaaggtctcctcatctaagagtgagtttagcaaagggcaccaaatcaaactggaagtgaactttttttttttaaacttttactgagatataacaaagatactattaagtgtataaatcttaagtgtactgcctgataaatttttatgtattatacatacacccacacaagcaccacccagatcgagatacagattatttagggcacctctgaaggctccctcatacctggagggaaccacatttttttgttagaagacaaacaagtctgaatccttcattttactgatgaaagcaggagtcctaaagacggaaagtaatttgcccaacaccagttttatatccgtaaaactgggtatagaactgtgctgtccaatacagtggctcccctgtggctattgagcattttaaatacagctagtcaaagctgagatgtggcacaagtttaagatttcaaagatttagttgaagaaaaagaatataaaatatctcaatttttaatactgctttcatgttgaaataatatttcagatatactgggttacatacaatctattaaaatttgtttctttttactttttcaaatgtagatactagaaaattttaaattacatacatggcttgcgttatatttctgttggacaacacctgtccagaacacagatcacagaaagtattatgattacatttgtgtaattatccaattgtttcccccactagaaggtaagctctactgaagataaagatcaaatctggtttttgtcaacattttatttccagggcttaagtacagtaggcactcaatatacacttgctgaataaataaatgaacaaacacctatggttagggccaagtttaggaccttttcccctataccacatttgcctctagtcagtccagagggctttctgaataatcaagacctcacataatctaaacatacaagaattatattttattatatataggaatataagcagggtccccaacttttcaaactagttcctcatttcatgcatgaccatagttcattcttttttgttttgttttgttttgttttgttttgttttttgagacggagtctcgctctgtcacccaggctggagtgcagtggcgccatctcggctcactacaagctctgcctcccgggttcttgccattctcctgcttcagcctcccaagcagctgggactacaggcgcctgccaccacacccagctaatgtttttgtatttttaatagatatggggtttcactgtgttagccaggatggtctcaatctcctgacctgtgatccacccgcctcagcctcccaaagtgcttgttttctcctttttgagacagggtctcattctgtcacccaggccggaatgcagtggcacaaacacagctcactgtagcctcaacctcccgggcttaagggagcctcctgcctcagcctcctgtgtagctgagattacaggtgtgcaccaccacgcccagctaattttttatttttttgtagagacgggggtctcaatttgctgtgcaagcagatctcaaactcctgggctcaagacttcctcccactttagcctcccgaagtgtggggattacaggtgtgaggcaccatgcctggcagactataatttttattgtttctcattaaatagcttattaagcagctacaataggattactcacctaaaagacaattcctgttataattatggaatagttaatccaacctgacaattctatatccatacacaattgatcttgccaattaaaatctaccagcaatagtaatggtacaatgaaatgattacagcttggcctgtctcaacatctttgttaataactaagatggagaaaagaaaacatatttaccaaatttgcaggtgacaagaagctgggcaggagaacaaatgtgccagatgatccaaccatgaaccaaaaatacttcaacaggttgaatctaacaagatcaacctaatggggataaattcaggatcctgcatttgagtctaaaagaacaactgtaaaagtacagcacagataagtcatgcctacctatgtgtgaaaagacttataggcttaagttgatattatgtgctcagtaggaatcaagaggataacaatgctgccctccaaattaatgtgattttagatacagtaatgcaaatataataccatcaatgtgtaaagtgagacttttgttatactcaacacaaaccagaacgtatttggaatactatccacagttttgaacattacattttaagaaataggaggactagaagtatcttaagaagaccagaagatatttaacctggagaaaaacaggaaagttgacttaaacattgtagaaaagcaattaaactgtttaccaaagagaatcaggtcaggcctggtggttcacacctataatcccagcatttgggaggccaaggcaggaaaatcacttgagcccagatgtttgagaccaacctgggcaacacagttggaccccgattctacaaaaaatatgaaaattagtcaggtgccgtggtgcatgcctgtagtcccagctactcaggaggctgaggcaggaggatccctcccaaaaggtcaaggctgcagtgagccacgatggtgccactgaactccagtctgggtaatggagtgagaccctgtctcaacaaacaaacaaacaaacaaacaaacaaaaccaaagagttagaatcagaaccaatgggcaggccatagagggagaaagatataatcaacattgaacagcaaaattaaaagcttactaacaggaatgtctaaagttttgtttttttaattttagagacagggtcttgctctgtcacccaggctggagtgcagtgacacaatcatagcccactgtaacttcaaattcttggactcaagccatccttccacctcggcctcccaaagccctgggattataggcatgagccactgtgcctggcctgagtgtctgaagatttgaataatcaaactgacaacctcaaaaagtagagaatttgtctgtcacggagaagtgaatcaacgcttggtgggaactcgggtatctgacagaaggttgacaacatgaccaggtgcagtggctcacacctgtaatcctagcactttgggaggccaaggccagtggatcacctgaggtcaggagttcgagaccaacctgtccaacatggtgaaaccccatctctaccaaaaacacaaaaattagccaggtgtggtggtgtgcgcttgtaatccagctactccagaggctgaggcaggagaaatgcttgaacccaggaggcagaggttgcagtgccaagatcgcaccactgcactccagcctgggcgacagagtgagattccatctgaaaataaaaagaaggctgactacatgatcccaaatgagatttactgatgtgattcgaaacttgtaggccaggcgcagtggctcacacctgtaattccaacactttgggaggccgaggtgggtggatcacctgaggtcaggagttcaagaccagcctgaccaacatggtgaaaccccgtctctcccaaaaatacaaaaaattaaccgggcgtggtggtacaaacctgtagtcccagctacttgggaagctgagacaggacaattgcttgaacccgaggggtggaggttgcagtgggccaagatcgcgccactgcactccagcctggtcaaaagagcaagactcttgtctcaaaacaaaaaaacaaaaaacctgtaacctctgaccccaggtagtgcttaagaaatagcactttgtaggctgggtgtggtggcttacacctgtaatcccagcactttgggaggctgaggtgagcggattacttgaggtcaagagttcaagaccagcctggccaatgtggtgaaaccctgtttctactaaaaatacaaaaattagccaggtatggtggcgcgtgcctgtaatcccagctactcgagacactgcggcaggagaatctcttgaacccgggaggcagagattgcagtaagtcaaagatcacgccactgcactccagcctgggcaacagggcaagactccatctcaaaaaaaaaaaaaaaaagcactttgtgacaataatgaaacaggtcacagaaaaaagatttggctactttataggacacagagcctattccacagcagaaacaaactggggaaaagttcaacagtcctttttcataagacttttctaaagttaatcaaatccctcatgtcagcctctcacctgaaaagacgctgtgtgttttgatgcttaagtgttgtcagaggccaattcatcaacagcaatagtgaggtaatggaattcttcatttatttgaaaattctgtagtttgttaatacacctgccctctgaggtttaaaaggcacagattttctcagaccataaactttctaactgtatcaacatgggatgaagtgttttttgtttcacaacacagtttgttctatagcccttacagataacagtgggctcaaatggttatccagttgaaaagataaggcaaaatgaagacactttcaaaatggtgactgacaattcactcaatgaacacaggagttcctattgtgtgaaggtgtatggttggatgctgtggggattatagtgatggctaaaactagaacccagcttttatggagcagtttcctctaggggagataaggtacaccacacatcaacagccctaaaagggaatgccatagatctcccaagagaagagtgcaatgaagtttaaaaggatgacttttggctgagtagaatcagagaaagcttcatggaaaatgaaacactgtacctggatcttagaaggataagctgaagttgaagaggttgagacaaaagacaaagggaatgtccagctgatggaatgttctaagcaaaggcagggccatggaagagttcaggatgttaaggtaacaatgaatacctagattgtggggaggacagggtataggatgcagaaaactgaagccagaaaggtcatgaagagctttgaaatgacttgctaagaaaaagtatggactttgctcagcagagagtggccagctactggaagaagattcgctccttagcactgaccggagatgagtctctgagaagttaaccttttcttcccagcctcaatcctataattaaatatacaaatatcaccagggctggaaaaggacaaatttggtgaatatagtcatgtaccacataacaattttggtcagcaagagaccacacatatgagagtggtcccataagattataatggagcagaaaaattcctatcacctggtctagatgatcctgacctggtagaggcctaggctaatgtgagtgtttgagtcacagtttggtttttgtttttttcagagacaggttctcactttgtcacccagactgcagtgctgtgatacaatcacatctcactgtaacctcaaactcttggactcaagctatcctcctgcctcggcatcctaagtagctaggactacgggtgcacgccactgagcccggctaattttttaaatttttttgtagaggcagggtctcaccatcttgcccaggctggtctcgaattcctgggctcaagtgatctaccttggcctcccaaagtgctaagatacaggcacgagccactgcgcccagctctatgtcttaatttttaacaaaatttttaaaagtagaataaaatttaaaaaaacagaaaaaaggttacagaataacaatataaagaaagctatataatgtgtgctttaagcttaaaatgtcagagtcaaaaagtttttttaggttgggaacagtggctcacacctgtaattccagcactttgggaggccgaggcaggtggattacttgaggttaggagaccagcctggccaacatggtgaaaccctatctctactaaaaatacaaaaattaaccaggcatggtggcgcgtgcctgtagtcccagctactcaggaggctgaggcaggagaatcacttgaacccggaggtggaggtttcagtgagctgagatcatgccactgtactccagcctgggcaacagagcaagactctacctaaaaaaaaaaaaaaaaatttaaattaaaaagtttataaagtataaatgttacagtaagttaagtttaatttattattgaagaaaaaatttcaaaataaatttaatgtagcctatggccaggtgtggtggctcacacctgtaatcccagcactttgggaggccaaggtgggaggattgcttgaggccaagagttcaagaccaaccaaggtaacaaagtaagaccccacctctacaaaaaaacgtaaaaattagccaaatgtggtggtaagcgtctgtagtcccagctactaaggaggctgatatgggaggattgcttcagcctgggaggtcaaggctgcattgagttgtgattgtaccactaaattctggcctggatgacagagtgagaccctgtctaaaaaaaaaaaaattagcttagcttaagtgtacagtgtttataaagtctacagtagtatacagtaatatctgactcatccagagcaacttctagttctgcaagctgtatttatggtaaatatcttatacaagaataccattttttatttcttatattgcatttttactgtactttttgtatgtttagatacatttagatacacaaatacttaccattataactgcttacagtattcagaacagtaataagttgtataggtctatagcctaggagccataggtcataccatacatcctaggtatataacaggctataccaccgaggtttgtgtaagtatactctatgatgcccacacaataatgaaatacctaatgatgcatttctcaggacagatccccatcattaagcaacacatgactgaatttactttaatagaacatcattttcagaatattctgatccagaaatataaactaaagattatacctgccttttgagaaatatacaaccagcaaagattgttataacctgtacctaattttgctgatactaacagtttagaagacatggattgacacctgaaaataaaaggagggcaaattctctttttttttttttgttttgagacagagtcttgctctgtcgcccaggctggagtgcactgacgcaatcttggctcactgcaagctccgcctcctgggttcacgccattcttctgcctcagcctcccgagtagctgggactacaggtgcccgccaccacaccgggctaattttttgtatttttagtggagacggggtttcacagtgttagccaggatggtctcatctcctgacctcttgatccgcccaccttggcctcccaaagtgctgggattacaggcgtgagccaccatgcccagccaaaggagggcaaattctcattactcctaaaacattggacccaataagttcaacagaccttttattgatgcagaacactaaatattgtaactcttcatttaacatcacagatagattcttggaaactgtaactgtaagcttaacaacttacgaaacctattttaccataggctaagtgacataaacaagagttatattcctacagtatatttctggtcacaaaaacatcactaaacttctaaataaagacccaaaagacttccaatattaaacactgaaataatgtgagctatgcatacattatggcacggcacactcacacccacacccactccaataaggacaatttagacatgctaattcaccttctgtgcacatctttgggatgtggaaggaaacaggaggacccagagaaaacccacctagacagggacagaacatgcaaactccacacaggcagtggccccagatgggaattgttatttttctcctcatcactgttataacaaagtgacattgaacagaacaatgtaatttgaagaaatgctatataaaactctaccgcaaatctcattacacataaagttgtaagaccaaaggcaaagaatcagtcttcctatcaaccggaagttactgaagattcccatgagttctactgggaaaataaggttctgatccacagggctgtccaatcaccagtacaacattcagctaattaaatgctcacctaattctttccctgagtttgtgaatcgaatttactaggtagttaaggacagaaaagcagtcctgttgtgaaggacttttttgtttatcctcttcaagggaaaagcagagctgaaggctgggccaaaatcttaagaagtcagctgcctggaatgtccagacaagcagctgaataccaattcttaggccacctgaccttgaagcctatcacattcaatttacgcttgtttgataactgtttttaaaaggtaatacatgtacatagtaataaaaaccaagtctccttcctaccttcatcccctgccaacccgttcctctcccaaagacaacctcagctactagtttcttaggaatccttccacatataacctatacacacacaagtttatgtatgtgtgtattctttttacataaatggtaccttctttatcttcccttttgtgctagcattctacacatactatctttttttttttttttttgaaacaaggtctggctctatcacccaggctggaaagcagtggtataatctcagctcactgcaacctctgcctcctgggctcaagccatccttctacctcagcctcccaagtagctgggacttcaagcatgcaccaccatgcccagctaacttttgtattttctgtagagatgagatggggtttcgccacgttgccgaggctggtctcaaactcataagctcaagtgatcctcctgccttggcctcccaaagtgctgggattataggcgtgagccaccacaccaggccaacatactattattctcagacattaagaaaaaattacatctgatattggaatggaaggatggaagtgaagaaatctcaactccaactctgtgtttcatccacagacaccccagtgaaaacttttggacaccagagataatagattactactaacttatttgaccattattagggtgacatctgattgacgctgaattcaaccagttagtttatctggcaatttttcctattctaaaaatgactaacaggaagaaagaaagaaaaaaaaaacttaaatagcaaaaacggacaagtgctataattaacagttaacacaactacgtgccaggcactatgccaagtgatttggatgcattatttttcctaatttttacaacaactccatgaagctgatacttgtgtccttactgtcctcatttcacaggtgagaaaattgagtcctagagaagtaacttgcccaatgatacaaacctagtaagtgctaaaactgagatctgaacctagacaatctgatcccagagtcctacgaaggtttttgttgtttttgcctcctttaatgattagaacaaaccctccaggatctattgaccctatttttcattcagtcctcacaagtacagtaatttaagcttcaaaactagcatcatattagaaatagcacatcaggaaaaaaaaagactggctaactggaggcaagcatacctataacaagagtaactgctagcagcctagtaggaaaagaggaaatgaaaaatttatttaatagagacacgaaaaaaataacagagcaattgaggttcaacaggtacaactcagagacaatagtctggcaaaatacagttaagagttatcaggacatcctgaatcattcagaaaagactgaagtatgttgaatggtaaaagaaaactaaataggccaggtgcagtggctcatgcctgtaatcccagcactttgagaggtcgaggcaggcagatcacctgagctccggagttcgagaccagcctggacaacatgacgaaacctcatctctataaaaaatacaaaaattaggccgggcgcagtggctcacgcctgtaatcccagcactttgggaggctgaggcaggcagatcacctgaggtcaggagttcaagaccagcttgaccaacatggtgaaaccacatctctactaaaaatgcaaaattagctgggcgtggtggcacatgcctgtaatcccagctgcttgggaggccgaggcaggagaatggcttgaaccagggaggcggaggttgcagtgagccgagttcacaccattgcactccagcctggcaacagagcaagactccgtctcaaaaaaaaattagtggggcacggtggtgcatgactgtagtctcagctacagtctgaggcaggagaatcgcttgagccccagaggtggaggttgcagtgagctatggtagtgccattgtactccagcctgggagacacagtgagaccttgtctcaaaaaaaaaaaaaaaaagaaagaaaaagaaacaaagaaaaataaataaaacaaagtcaaaatggttaataaaaataaaagacttgaagatcctgctacccactgcaaaacaaagccaacacctgtcacagactctgaccatataacaataacgttgagtcattaagtaagctatttcacaatacagctcactttaactcacatcatgggtgtataccctcataataaatgcctaaatttaacattgagaggtcaaattacattttgccactgatttaaagtcataatgtcagacctctgttggaaacgagggggaattgagaagggcagggggcattatggaggggataacacacttccatgctaaaacataataaataaaaactgcccttaagaatgcaggctgggcgcgctggctcatgcctgtaatcccagcactttgggaggccgaggagggtggatcacctgaggtcaggagtttgagaccagcctggccaacctggtgaaacctcatctctactaaaaatacaaaaattagctgggcatggtggcaggtgcctgtggtcccagctactccggaggctgaggcaggagaatcgcttgaacttgggaggcagaggtagcagtgagccgagactgtgccattgcactccagccttggcatcaacagtgagagactctgtctcaaaaaaaaaaaaaaaaaaaaaaaagcaaagtatcagtgtgccaatctgtatccaggaaacaaaaaaaatgcaaaataaacttaaaaaaatcttgtaatgaaaaagattcctatattaattaactaatcatttattgaacaagtattactaagcacctactctgaatatagactgaatctgtgcagaagctactactctgtttaggatcaaactcaagttgctcctcccaagtttgatgtgtcacccaggctggagtgcagtggcatgatattggctcactgcaatctctgcctcccgggttcaagagattctcctgcctcagcttcctgagtagctgggattacaggcacccaccaccacacccagccaatttttgtatttttagtacagacacggtttcaccatgttggtcaggctggtctcaaactcccgacctcaagtgatccacctgcctcagcctcccaaagtgctgggattacaggcgtgagccaccgcgcctggcctgatgatgttcttaaacccacaatttattatttaggttttaagcttcacagtactatccttgtctctcagtgattccagtggctcatacataatactgatctcttttacatataagaaaggcaaataacgcagctagcaaagtaaagaaaaaaaggagtgttcaaacctggcgtgcaaatatctctaaaaggcaagcatggagacgggacaaaggaagaaaatgtcactcactaggaatatcaaataataaagggctgaagctatcaatcctgccttatagaaaataataataatgattactaccatttactatgttctgtaatgtgagacttgtcactgtaagatgcatttacattcattctgtctctcaggacattataactgtccccgtttcacagaaaagaaaacacactctgaagaggttaagtaacttaaggttgcacggtagagaagaaagaagctggaatgaagcctgagctcccccctttttctcccattctgtgatagcaccaagaacctcttcctgctaaataagacaaatcggaaggcaacaacactgtctgtagagttcaaaggaataggagagtttcctagctatgatttcctcctgtcagcctaaatctgggagggaagattcttgttattcctgatgctgacctcctgccaggtactggcagctctgagcatcctgtctcgctcactctgcttgggccctctgacaatgccagttgtgttttggccttgtttctcccacatgatagtttataagctgcttagagtagatctgattttgaattaataaagactagcaggcacttgggcaggttcgtcactctggctgctatgaaggaatcccaaaggggactttcacacagcatgtttcccttactctgtcaccagctgaggccaagaaagcagagcctagatggctacactcaagccccagcagtgtgctaatgaatgagtttattgatctgtaagctggcacactgacccttttccagggctgtgtacatggctatctccacctggtttcccaaactccctcactatgaagcctaacccttctggggggagcatgagggccacaggacagcctgtgggcaaacagacaagttgggtgaggcacttcctgaagccatctcacctgacaacgagcctcctccaagagctacacctggcctgcagcttgcctgtcagatccactataaagaataagcccctgggtaccaggtatcagcgcacttagggtatgcaatgctggtaaaatgctgctgcataggcctttggtttgggcaagaaagctacaagcgtgggtgtttgaacactgcaactctggctgggggagggcaaaagaggatgtgcacatggccagggctcaccatgtatagcaggcctggggttgctggaatccagcagaagcctgaatgccctacagctacatcaaaagtgctgtggtggttttaaagagcctctgcagaggctgccagtgtctgccggtgcagttctctggctgcgctgagactggcaccagtctgctttctaaccctttcccatccccacactttaattccttcttttctttcccaaaggcttcttcccttcagcttatgaaatcattccagtgtttccccattttaaaataaaaaacaattaatgcttcccttctgaactgtttttccctcaagcgatcatcccctcatttgaaacttcttgaaaagtagtttacaataacttctttgcctcttaattactcctcaatcccatatagtctgttctggcccccagaaggccaaggcaactgctttccttgaccatccccaggcaaccccccttcccccgtgatcccatataatctgtacatcaccctgtgctagtttcaggtttacctgtggcctctcccaggacacagatagtgagcgccaagaaacacggggcccatcatacagctggtgatccgtaaatgtttgctgtgctcatatgacatgttcatactcaggggaagagacccctatcccctgaccaccaaataggacaatcagaaaggaagcaaagtgtttagaaggggcaggtaaccatagttaacttcagagttgtctcgggtcagccactactgagtaagtggcctgagacaattccttaaaattgccaaaactgtctccccatttgcaaaatgagagaattggactagatctgtagtttttaaactacattctgagtttccatggaactacttaacagtcttttttcagtggacatgttgtgaagatgtgaagcaagcaggtcattcccacctcctttcatcatatttatcatatatggtggctgagcataagatttcatttttaaaaaggactctgctgataaaaagtttgaaaaccactagatccctctacctggaaggctttttcatccactctttcacttgctaacttctactcaccctttaggtgtcaatgtaaatgtcctcttcagtgaagccttccctgactgacccacccctaaactaaatgaggttcccagcttctcccacatagccttgtcacatcctctcattgcacctatcacagttgtattttattagtgatttgtttaatgtctctcttctcacctaagccttaagagggcacgaaataaatttgtctgctgtacacagtaccttcaatcaagagaataaatgccataattttatgaatctatgtttaagtaggtactttagtattaattaacattaatttaagtatttaattagttactttagtagttataattactaaagaggaaagcaacttaatgctttcagttagccagaccagcacctgaatttcctctccaccacattctaactacttctttgggaaagttctctgacttctctaagcccctgatccctcatatgtaaaatgagaataaagtagttgtgagcatgtgtgaaataatgtatgtaaataaataaatgataatatacataaaacacctagtagtaattgtatttatgaaatacctgactttaaaataatctttaaaaacagactacattttactccctctccatcgtacctccatcataggtatgttccaattttatttgttccattccattttgtaaaattaatttctgcactgagaaggtactagtgctccatgacaatttgaaaaggggagtctctacaaatctgttaacacttacaatgccaacacaaattccaactacataaatctccctgcccagaagggaaggtttcaaagcagagataatacctgaattggatactgaaggaaaaacaggaatttgtcaagtggagaggcgggggaagggccttctaggcagaagaaactttgtgcagaagacttgatatttctactacatagttttgctttttcttgcagagaagggagtagtgatggtaatagtgcctaaaatagcaacaaatgagactagtaaaggcaccataggtcacatttgatcagatgtgaatgccatgatatgaaacttttattttattttattttccgagatgaagtctcgctctgtcgtctaggccggagtgcgtggcgccatctcggctcacagcaacctcagcttcccaggttcaagcgattctcatgctttagcctcctgagtagctgggactacaggtgcccgccaccatgcctggataatttttttgtatttttattagagacagggtttcaccatgttggccaagctggtcttgaactcctaacctcaggtgatctgcccacctcagcctcccaaagtgctgggattacaaccgtgagccactgggcccggccaaaacttgtattttattctgagaacaatggagaacattaaggagtgagtgcatgtgtgtgcgtgtgtgtgtgtctgtttgtgtactgaccccatttgtactgagaaggccaatggaatggggatagggaagctagaggccaaagaccacttttcaagtactgttggttgcaactcagtgaaatcaatttagtgggtgacattatcaatgtctgtttaaaatgaattcaaatggaatagaaaatatcaggggttccctctctcagccttggagcctcctccctctgtctctgtacaggggagctgcttctttcttccttcccccttctttcttttctttcttgcctattaaactccttgctccttaaaactaaaaaaaaaaaaaaaaaaaagaaagaaagaaacaaaagaaaatatcagagattacctgacattataaggataaattttacagaacttctgtatcagattcatgtgtccattctggtcacaaagtaacatgcatttgttacgatgggtcagagtcaaaaaaattttgagttaggtgactgagcaggtgaaggggtgagagaagagacaaatgagggctcccaggtttctggtgtgggcatgatgccagtggccaagacaggatataggggaggaggcctgcttttatcaagtccacgtggggatgctagacagcgcagacagtggcctctctcagcattttttcagcagccacagtcaatactaatcttgttcagcaaagacaatgaacacatagtcattgcagctgcaagctcaagtgagtatacaactgataagggtcctctaggagctggagggtgtcccagtcctaaatcctaaaccacagaaaaactgtgaaactaaaaaaatcagacaggataagtgaaacaccatttcctccagggaactaacagggtgtgagaaatcttgtccttattctaagagtcaacagggaacccttacccttgggaacctaagcaaaccttctgaaatgtcagcgaccagggtatttttgtttattagtagtttgtttggttttggttttgtttggcggaggaggcattatttctacttttctgttttctaagcctcctcccccaccccacactaccacctccaagaggtacttcaacccctatgcctccagcaagtccactgagtcctgtaatcttgatgtggctatccttcggttaccctcctggagcttcaggctaagagagcagggccaatagaacatggcttctccacagacttggggtggatccatcattcctcctaacagcctgcccaccccgcccctgcacgattccattagaagaaagacttctccgattcttggaggatcacagcacaactgagccccaaactaactactttcctggtgacccttccactacattcctcaataaacctgccccagacacatcaggcaactggctgccctcaaatactccatgttcttgtacacattctatcttttgctcctattattccctcaatctaaaatgcccaccctttctctgacagaaattctagtcactcttcgtggtgcatctcaaatgtcacctctaccacaaagccactctttatccaacactccaccccatcaccaaatctggatttagttacaccactttgtgcttccactgcatctgcctgtgtcttgggcacagcatttctttcactggcatgcattataggcaatcgtgctttatgtctgttttccattagacttacatttcttgaagatacagacacagagtctgtatctgatttgcccaaaagaaattaccagaaaagaatgcatgtcatacccttctctccaacatcccatggtcctgcacacataggaggtcctcaagaagagtgctgattcaaactgaaaagctacagattctttccaccaaaacctgcatatcatcagaactaggcgagagaaagagtggaaggggaatcaagtatagatttgaagcagacagcttccctctctcaattgaactgggggtggtacaccctactcctcagaaattaaaccaacctcagcaaggaagattaagcaggcacagtttggaaactttaaagaactataagtagtttcaaggttctcccatctgctgttagtcaggtattgaccttgggatgtggtcacagggattatatattttattttattttgccatccactccctctaacactgatacctctagctatatgggcaataaagagtctttcatacaggttctgaatattatctttgagttcccctagccttcttgcaaccctcccacctttccagtgagtaattttacagtgccacctctacagtcctcctctcctaaaaaagcactttttcccttcaatatatgcagcttccttccctgaacgctatgccttacccttcaccattcagacaacaagatggcaggcagtgtgccttttaagctacctgatgcgtggcacatttcaaagaactaacaggtagaagtataagggttttgatagttgcagcttcctttgtgatcctataagtacttcttactcatatttattatataacttaggcattctgatttataattgaccattttacacatcttatctccctcactagactgtgagcttcttgagaactattccctagttcccacaaagtgcccaggatatggtgtgcacttactaaactactgcttagaaaaagatagcataggctgggcacggtggctcacgcctgtaatctcagcactttgggaagccgaggtaggtggatcacttgaggtcaggagattgagaccagcctggccaagatggtgaaaccctgtctctactaaaaatacaaaaaaatcatatgggcgtggtggtgggctcctgtaatcccagctactcggagggctgaggcacaagaatcacttgaacctgggagacggaggttgtagtgagccacaactgcaccactgcacttcagcctaggcagcacagtgagactatgtctaaaaaaaaaaaaaaaaaagcataaaataaactgccaccttaggcccctaagccaaactcagtgtaactgtgtgagtacagaggaagaaacatttcagaggtgatcaaaaccaaaaagtatatagtagtcagttgtatgatgcaaaggttcagctgaaggcagtctcaaacaagggtccttttgacagggcagccattcccatgttcctcagatactcactatggtcaaagtagtaaacttagttctccagaatttactttcccaagatctggcagttcaataaatacattccccagcccctgacttcaacgactctcctatatccttctgacctttaatactgtgtaacattagatgaaaaattgattttttttggctacttatttcacagctgaagaaaaaatatactgtttaaggtgttaaatatttttacatgcaacaaacctggcatgaagctaacttgtatgcacattttagaggtacaggcgtaaatgtcagtgctataatttgttataggtttctgatgaccagcaatgaaaatgaccacggattctcacaattcaaaccacttttacgtaaatgtgaactttcctaaaacagccaagggagagaaaactttccatccaagctcatagagtgtgttaagagatactgatagcattgttcactgggttaggtgttctctgaaaaaatcctacaaatattagtttccttctgggcttatgctttgacctttaataaaaatgtgcttcaagacaccagttattaaaatgaaaggaacagtttttaacacctgaacaactgccatttcatataatcagccctcctgaaggctataccttacaagtcagcagtgtttaaaaaaatacatttggtgacttcatttaaattgctcacttaccagacgtggagtagggttataagaaaccatgaattgaatgtatcaggcatctgacaccctagaaaataacaataaggtataagtatgtgagggtttaaaggaagcatattgaccatatattaaatattggcaggcacggcacttatggtgctctctgattatgctattgcagaaaagtccagtagaacaatagggcgagaccacaggataaaagaactttgaatcatagcacgccaggagtaaaagaaaaaaaaaggatggatgcggtggctcatgcctgtaattccagcactttgggaggccgaggtgggcagatcacctcaggtcaggagatcaagaccagcctggccaacatggcgaaaccccatctctactaaaaatacaaaaattaaccaggcgtggtggtgggcgcctgtaatcccagctactgaagaggctgtggcaggagaattacttgaacctgggaggcggaggttgcagtgagccaagatcacgtcactgcactccagcctgggcaatagagtgagactctgtctaaaaaaaaaaaaaaaaacaaacaaaaaaacaacccattgaatttagtcagaccaccagccttctagttccagccctgttaccagcttgttatgtggccttggacaaatcacttctcccctttgagtcttggttttctcactttgcagaatgtggcctagatgatttctatggttccttccagcttccgtgtgcttctacagtattttccctccatgggcttgaattctgaaaagctaggcaaacactcccttacttttttcagttgggctccactgagaagcttaagtctttctagtatccttttcctgtcttctttctctaaggtacccaatgtgctatggatatgggtgtgctaaatgatttgcccaaaagaaatgaccaggagctgggtgcagtggctcacacttgtaatcccagcacttagggaggctgaggtgggtggattgcttgagcccaggagtttgagaccagcctgggaaacatagtgagaccccatctctacaaaaaactacaaacattagctaggcatggtggcatgcacctatagtcccagttacttgggaggctgaggtggaatgatcacttgagccagggaggtagaggttacagtgagccaagatcatttaactgtactcacgcctgagtgacacagcaagaccctgtctcaaaaataagaaaaaagaaaaagaaaagatcaggcgaaaaaaatcagggctctagggagctgcagctgaataagaaagcatattgtacttactgaaaggctgttcatcacccccccagaaatgacaaaactgggaagggcttctccttggtttcagatcccacaaattagttctgtgctcagacatcaaagcctctcaattctcactcagctaagaaaagcctcctgctggatgaggggtctcccactgaatgtgcccgccttattacataacagggagaaaagccagagcaagaggaagatgcaaaaagagaataagtggggaatttgggcccttatggtagaatctgtcctttggggcaatgactcaagaaagaagcgctatcctctgcttttcagcaaccatcaaggtacatgatgtactaaatgataacaaagaggggacactaggagataacacataggcccggacccccatgaggtacattaacagcaccaataataaagagctgtaattcactgcgggcttactatgtgccagatgttctactgggttctttacatccatgagctcaatgaatcctcccaataaccctgaggtaggcattgatattatcccaaattgacaggtaagaaaactgactcagagagaccaagacaattgctgttcaaggtcatacagctatgaaaagagacacctgagatcaaattcagatctacttgattccaaacactgtgttcttaatcctgctctaacagcctctctaataccactatcagaaactaactcactaagggcccatctgcataccagatctactgcaagccatgtcaatacattatctcactcaatcctcactttaaccctggagggaagcattataatcctcattttagagatgaggaaacagactcaaactaagtaacgtgtgggcagccacaatattaacaagctagtggcagggctgcagtttgaatccaagtctgtcacaaagtgacaccaaaatactttggtgagcttactgggaggtgcctagcagctgtcaagtcgacttcctctcagagcccagcaggagggagctgaaggctggcctggccagccatacagctattaagacacatgccatctgagaatgggccaaccaccctccacctagacaagaatagccctgagaaactctgaagcccggatctgaagttgggtcttttttggatgctagaacaaaacattaaaaagaaaaattttcttggaagtctgtctttcaatctggaaaatgaaatttggctgcttctaaaggacaatctgttcaattgctacctctacatcaaagcttctcagcagcctccaggagcctttccaattttctcagagagggaatcagttcttgggctggaaagcacagacagacaggccagcagctggacttgggtcaccatttccccttctggggtcacctcagggctgagggtgggaaaagtgctggcatatgattgagtccctatacacactggtgtcagaacagaaacccacagggtaaagccctaaaaagtaacaccattgactgttgactgtgaactatgcaaaaatacagcagattctttagttcaatgaaatgcatttaaacacttcaaagttaaaacctgctgtagtattttgccatgatcacactcttgctccaatgcacattcagtgctttagtttctgaagctaggcactttctttcttgacatcaagttggatacaattaaatagttcattactgttatggggtggcagcataacacagttgtacatttaatgtggggtcagactgcctgattcaattctttgactctacctctcactcactatgtgacactgggtaaaattactcaattttcttctctgtaaaaatgagaaaaacaagataactgaccttgtaagatttttgtgagaatgagataaggcctataaaatgtttagcaaaatggttagtattaagttagtaggtactcaataaatattcactattgttggttttcagcaaattatttaaatagtagaattgaaattatctttgaaaaaccccactaattatttcagattgtatcagtgataaacctcaaccacagactcagaatgtattcattaaggagcctcctctccaaggcctccagtctcttaagggttaaagacaaagcagtctgcagacaacactgtggaattcaacaggagctctactgattgaccacctctgctccaaagtgctcttcacagcaaacatctctaaaagaccagtcagcaaaccgcagtgtactcatcagtgcaacatgctcagacaaaagacatcctcaaaatatctaagaaacagcgggctgctgaattctcaggactccaaaagttaagccctaaaataccacaagtccaagtgagcaatgaccactttaaaaagtacaatcttgggaagcaatatatatatactgctttctcttgtttctttttttttttttttctgcccaggctggtcttgaactcctcagctcaagggatcctcctgccttggcttcccaaactgctgggattacacgtgtgagccactgcacccagcccctttctcttatttcaaacctgtctggcctactctttagaatccaagccacaggaaagtcagtgtaattatttgaaagatatttgtcatcttctgcatccagaaggtatattccagatttgttccctttttattcactagccacagtttggaagcactttggtttgatatgaaaacttaatctacccacaaatgacaaagatgggccacaacagaatgtaataaaaatgaacatgctataggtctcaaaaggaaattctcaaattgagtctcagaaaacctgaagagtagcgttactaaaaaatttactttctccctaggtaactacttcaaagactaagctaagacaaagctcaccaatagattcacactataattagtataaacatcagtttccaatactaatagaaaatctcacagaggtagtttgcatttaaatataacaaaatacaaaaaatattaaaatgaattacattttctaatttgcaattacactcattcacagacaatatgttatagtggagaaatccctggattttaaaccagacaacacaggttcaaggcttggctaggcaaccctgggtgagtcacttagcccctttgagcctcaactgtttctgaaaacaaaataaaacaaaatgaaaacagtaatacaagcccttcctagcccacaatattttgtaactcctaaatgagacaaatataaaaccatactatatgagctaatagtataaaacagttatttataaacttttcttaagttttataagtagtttacaccaggctatgaattgaaacatgatatgttaaatacgtaaaaagtcttattattcaatactacaatattaactgaagaaccttcaataatgaacagctggccaagacaaagttatctagtaaacatcctttcaaaataattctaagaaatttctgagttatttattgaatcaaatataaaatagacattaaatagacatctgaggatgagggttttttttgtttttttttttgagatggagtcttgctctgtcgcccaggctggagtgcagtggtgtgatctcgactcactgcaacctctgcctcccgggttcaagtgattctcctgccttggcctcccgagtagctgggattagaggcacccaccaccatgcccagctaatttttagtagagggtgggggtttcaccatgttggcctggctggtctcaaactcctgacctcaagtgattcacccacttcagactcccaaagtgctgggattacaggcgtgagccaccgcgcccagcctgaggatgaggttttaaaaagacctgatgaaaaatacttcacacatggattcaagaaggcacttaaagaaaaaaaaaaaaaaaaaaaaaacaggctgggcatggtggcttatgcctgtaatccctgcacttcaggaagctgaggcaggatcacttaaggcctaagaccaggagttcaagaccagcctgggcaacatagtgagaccctgtctctacaaaaaataaaaataaaaaaatgacccaggcataatggcatgtctttgtagtcccagcgactcaggaggctgaggtgggagggttgcttgagcccaggagtaaaaggatgcagtaaaagggctagagccactgattccagcctaggtgacagagcaagatcatctcttaaaaaaaagaaaaagaggccgggtgtggtggctcacgcctgtaatcccagcactttgggaggtcgaggtgggtggatcacaaggtcaggagttcgagaccagcctggccaatatggtgaaacctcgtctctactaaaagtacaaaaaaattagccgggcatggtagcacatgcctgtaatcccagctacttgggaggctgaggcagaattgcttgaatccgggaggcagaggttgcagtgagccgagatcacaccactgcagtccagcctgggtgacagattgagattctgtctcaaaaaaaaaaaaagaaaaagaaaaaaagcagtttctaatattaatagcttcatcagatagagaaaaaatattttttccttttggactaacttatcctagactaacaaagaagcaggaaaatattctttccaggttatgaataaagaagaaaggaaaggtgaacactaaattggaattataattcagtatggtatttcagtttttggtgtcaatctgctgagacagtaaaataaaatgatttgtatttatttgatttttaaaaaccaaaataggccaggtcccatggctcacgcctgtaatccggaactttgggttgggagactaaggcaggtggatcatgtgaggccaagagtttgagaccagcctggccaacatagccaaaccctgtctctactaaaaaaaatacaaaacttagctgggcatggtggcgtgcacctgtagtcccagctactcaggaggctgaggaacaagaatcacttgaaactgggaggtggaggtagcagtgagccaagatggcaccactccactccaatctgggcaatagagcaagactcaaagcaagtctcaaaaaacacgatgcaacaaaaaaatagttattaaataaccaaaactgcacccagctttcttcattgttgtgaacacaattatatacaaatatttgctgctagagaaaaatctcaaatgtatacagttaggtgtatgctgctttgaggatgtgactattaccacagaagtacacagcatacatttccttccaaaacctgtggaactggaaatgatttaatctctcccaattacaagtacctgctttaattaactttgttaataatataactgtttacagcatcaaaattaatactgtgataacaatcaactgcttctgacagtctaaaccagcaaaacccttttggaaagcaatttatcaatgagatatacataataaaattatatatgccttttgacccaatagtcttttaacatgagaaaaatcataattaatccaggattaattaaaacaattaaaaattaaaaacaggaatagctggccaaacgtccatgtcaaaatgctaagtaaaacatccagaatgggccaggcacagtggctcacgcctgtaatcccagcattttgggaggccaaggagggcggatcacgtgaggtcaggagtttgagaccagcctagccaacatggtgaaaccccatgtcaactaaaaatacaaaaattagctgggtatggtggcacatgcctgtaatcccagctattcgggaggccgaggcaggaaaattgcttgaacctgggaggtggagaggtggaggttacactgagccaagatcgtaccactgcactccggcctgggctaatagagcaagactccatctcaaaaaaaaaaaaaaaaaaaaccatccagactgtaaaacagaatatgtttactatgatatgaatactcttatgtaaaaagatgcatgtgtggacaagggagataatgtcaaagtacagtttgtttgttttttcaaaataagcaaaatgttttatttataggatccttttgctctctgtttactctattaaaaaagaaaagcagctgggtacagtgccatgtgcttttagtcccagctactattcaggaggctgaggtggtaggactgcttgagcccaggagttttaggccagcccgggcaacacagcaagacccttgtctctaaagaaatatatacaagaagttttttaaagagacaaatagacagtttggattatatgctttgtgcaggaaaaactgtttcactagggactaaaaaaacctatcctattaaaacacaaccataaaaatgaaatgtagatttgttctccttttcagtactatcaaacaataacttacttagaaagaattcctcgaagtcagttttctccacacagctagtatacatgcgcagggccgcaatcttaatcttctagacaaagagaataaaaccaaactcaagacatgaccaagtggatgttctacttccattagacatgggtcacaaaatcttatatttcttcaactagaaggaagggtccaaaccactctctaggtaatttaaaccaatataaattttttttgttttcttagagcttagccattcatacagacttcacacaattttcatattttaggactttagcatgaaaacctcagaaaggcttttccaatatttaaatgaaatctctcatttaattccaacctacttcaccacatttgtgcctctaaatcactgttcagcattatccacattaactctttagaatctgaaatcctttatagtaaaaaagtacacattcttctggccaaaatcaaagaaatatacaaaaaccctcaagcctttaatctttcctcagaggcactactatctattctataaatctcgggggatggagtaagcggtatcttttttccagatctttaattttatagtttgctgattaacactgtgtctgtaaataagggtttctaatgactgtaaaatacaatataagaatcaaacttttactattcccaaagcactaggaattctcttaggcttttgatatgagtggtggttttaattttttcactgagctgtatacttaagatttttatattacactgtatataaattatgccttaataaaaataaatctaaaaataaattatttaagagttgacttatgggtctgaagaccaactcagcactctaggaacaggtattttaaggactttcaaaacatttcattaaggatataactaaataaatgagcacttcaacaaggcttctagaagcttattttttcttataacaacagggaaagttataaactcaaatatgcatagaccaaaaacaaatgtgtacaggctgagaatgacatagcaactgaagaaaaaccaatctagaatttagtggagctatgatactaaggtttaaagtcaccaagaacatactatacccaaaactatataatgttcatgtttttctaaattctctagagttaaagcaagtgtctctgatgggtagaaatacccatagcaaattaaagaatgattacgtctctgattgtaattaagatattttatttgctaacttgagatctgtcatgtttttaagagcttccagtctaaagttaatacaggggaaaataggacatatagaaatagacaaataaaaatcagatatccctatctggggagtaaatcagcattagaagcccacgtttaaacaaaacccatggtgaaatgctagaaaagcaaagcaaattaaacctaaaagcaagcagaaagaatgatatagtaaagatcagaaatcaacaaaactgaaacaggaagataaaatacagaaaattcaagccaggccaggcatggtggctcacgcctgtaatcccagcactttaggaggctgagacaggcagatcggctgagcccaggagttggagaccaacctgggaaacatggcaaaacgtttccatctctaccaaaaatacaaaaattagctggccatggtggtgtgtgcctatagtaccagctactcaggaggctgaggtaggaggctgagcctggaaggcggaggttgcagcaagctgagatcacgccactgcactccagcctgggtgacagagctggaccttgcctaaaaaaaaaaaaaaaaaaaaaaggaaaattgaagccaaagccgtttctttaaaaatatcaataaaattaggttgggttgtggtggctcacccacccggctcactaatcccagcactttgagaggccaaggcaggaagatcaactgaggtcaggatttcgagaccagcctggccaacatggtgaaaccccgactctactaaaaatacaaaaattagccaggcatggtggcaggcgcctgtaatcccagttacttgggaggctgagacaggagaatcacttgaacctgggagggagaggatgcagtgagccgagattgtgccactgcactccagcctgggcgacagagccagactccgcctcaaaaaaaaaatcaataaaattgataacctataaaactgatcaaggaaaaagaaaagcccaaaacacataagatacaaattttcagtatcaggaatcagagagcagacatcactgcatatcctaaagacattaaaaggataataagggaatcctatgaacaactttactccaatgaatgtgattacttagatgaaatggacaaattccttgaaagatacaaactattaaagctcactaaaataaataacatgaacagtcttgtatctattaaagaaattggatttgtctttaaaaacctccccacaatgcaaactgcagacccagatagcatcactagagaactgtactgaacatctaaagaaatgttatgaaatcagccaggcgcggtggctcacacctgtaatcccagcactttgagagactgaggtgggcggatcacgaggtcaagagattgagaccatcctggccaacatggtgaaactccatctctactaaatatacaaaaattagctgggtgtggtggtacgcgcctgtagtcccaggctgaggcagaagaatcgcttgaacccaggaggcagaggttgcagtgagctgagtgcgccactgcactccagcctggcgacagagtgagactccatctcaaaacaaaacaaaacaaaacaaaaaaaaaaagaaaaagaaaaggaaaaaaggaaatgttacgaaatctacacaaactctgccagaaaacaagaagaaaggatatttcccagctcattcaataaggccaaccttatcctgatatcaaaatcaaagtcattaggagaaaacaaaactacagaacaatagccttcatgaacatagatcattgatgcaaaattccttaagaaaatattttaaaattaaatccatcaatatttttaaaaggatagtatatcataatcaagtgaaatttatcccaggaatgcaaagataattcaacactgacaaatcaatcagtttcaccatatcaacagaccaaaaaaagcctgtttaattttgttaacacttgcagttctaggaagtatctgaccacagaacacatcttgggaagcactggtctgtgccattaccaaactaatgataatctaataatatcatgatcctaataatttggccttgacaggcctactcctatccttaagacagggagttcaggacatctgccctagctcctcacttcatccaataattcactgagtacataactcagtgcctggcactgatctggatgatgagaatagagcagtgggcaaaacagacaaaaatctctactctcatggagcttacggcccagttcagctacagacaagtatgtaactttaactaaaatttctaatcatctatttcttgatttttttaaatcttgtaatctccttcagattcctatatataaagtcctgggttcataattaatcaccttgcctggagacttgccttcaaggcccaaggcccaagtctttccttgagaaggaagcttccccaacaacacgtttgtgaaaaagcattcatcacaaacaatgaagacttcaccagattggccagagtatgttttcagtgctcatgctatggcaatcaggagcattttatagttcttcacttttcctgctgcaaggccaagcctttatacttgggtgagccattttcctggacaaatctctaaaacaagtctctaaagactatcacacagagactggaaataataacttgaggaaagaacctcatcaagaatcatgcactgatctgagttaaggacgtagggggactgaattttcaaccagtcaatacaagttgttctggtccttggatgacttcatatttatttcattttaattttagaagacttcatcagtcatcttttacttgagtaaaagagaggcaccttgaacagctttaggaaatgaaaatctgctctcccacgaactaatgcattttttaacatcctacaggatgaaaaacaaatctagtaaaatgcttgcattaacagctatgtaagagtttgaaagggcctggcaaggtggctcatgcctgtaatcccagcactttgagaggccgaggtgggcggatcatgaggtcaggagttctgagaccagcctggccaagagaccagggtggccagtatgatgaaacctcatctctactaaaaatacaaaaattagctgggcgtggtggcaggcacctgtaatcccagctactcgggaggctgaggcaggagaattgcttgaacttgggaggcagaggttgcagtgagccgagatcgcgccactgcactccagcctgggcgacagagcgagactccaactcaaaaaaagataaaaaagagttagaagggtgttttaagtaatttgaaccttctattgtctactggaaatccttctacagcattcttgattcacagtcaaccatctgggcctctgttcaaacaagaccaatgaccttgtaaggctacctgtcccacctgaggacaattcttgttagattcttattttgctaaacttaaaatctgcttcatataacattcattgaacattattctgcccactggaataccttctttttttcacatttgcccctcaaatacctgagaagaatcatcctgtcttctcttttccaggctaagcatccctatttccttcaaccgttcttaacagtttctgaaatgttcataaggctcactgcctacctctgaatacattccagtttgtcagtgtccttcagaataggaataactttttggcttaatgctaatatggaaacctattctatggcatgtggctgagttgggtaaatattgtgcttatctcacctgatactgcatataaaggtaattttttaaaatgatgattccaagatactcaaataggtaagggaaagctacatttaagatcctaaacatgattatcaaacatgggaataacacatgaaacctaaagaaaaagatagagaaaagatagctgatactgctgatgtggacagacatgcaggtattttactccctaatcaaatacatgtgaaaacacaaaacaaataattttgccagtgcaatccaatacaagtgcattgatttgagtcaacattgctgaaaacggttctgtttttcaaaatgaaaagttacacatacattttcacatctcaattacactagaatgtcatacgttgatattgtgatgtaacaaattttaaaatgaaggttataggctgggcgcagtggctcaatcctataatcccagcactttgggaggccaaggcaggcggaatcacttgaggtcaggagttggagaccaggctggcccaacatggtgaaaccccatctctactaaaaatacaaaagtcagccaggtgtggtggcatgcgcctgtagtcccagctacttaggaggctgaggcaggaaaattgcttgaacctgggaggcggaggttacagtaggctgagatcacgctactgtactccagcctgggtgacagagtgagactctgtctcaaaaaaataaaattaaaattaaataaaataaaatgaaggttatagaaagtacacaccatcacatcacaagagttttaaaatgcaaacattagggatttagttgatgtcacaagggaaccaagaaaaatcagaggctaacttaggctaaaagagcaaaggaattttcctgatgatttagtaatcctccaaatgatagccaattttctctctagaatcattaaaaaacagcctagacaaaacatatggtagcaaccaagtggaacccaatcaccaagaaatgaataaaactgtaaatgtttcttttcttttttttgttttgacttccctcttaatttctaattttcaaacaaaacatatactttaagtttgtaaatccaaatgccataagcataacatttttttaataggggaaaagattctggttaaaaacattaccaagtatatcaacaattatcaagtgtcaaaaattaagatattaaaaaatacaactttaaagaacataactaatatttcattggcaattaagaagatacttcataaccttagggactcaagaacatcattgtcagtatttgtgttctttctatattttttcaaagctccttaaaaacaaaatgcttgtggaattactgttcacttttcagaattcaggtaaaagagtaattatagagagaagctcatatttgctgtagtgagaattgttagaaagagaaccagacaccataagaagaaaccacaagtagaagtctataataaaattgaaattctaatttgaatccaacttgttaaaatggtgtaagtggcattacttggttgttctcagtaaagcttatatattttctagaaaaatcttccctactgctttgagtgggcttgctttgacttatgactgattaggcttacccaatattccagcaaccctgaaaggcattaaaaggcacttctgccatagtgaaagagagaaatggtattacaggttgagtattccttatctgaaacgtgtggaaacagcagtgttttgaattttggatttggggggattttggatgctttgcattatacttaccagctgagcatcccaaatccaaaaatccaaaatgctccagtgagcatttccctggggcatcatgtctaaaaactccaaacgttttagattttgaatttccaattttccaatttgggatgctcaacctgttctaggagataagtgggctgagaagaactgaatcgctgatgttttatttctataattggttagaggtattattataaaagcccaggggcagtatgcatctgaggcagagaggacattcattcatttatagccactactattataacagataatgtgctaggccaagagttgactgggagtgacatggttaacaaatatccctccataataagaattacaatagatcgtgggcttaattagttaataaaaagatgattagtaaaattttaaagaaaatcccttataaaatatgggtccatcagaaagtaatgcttccttaagaatgttgccaatcagaacatttggcccatctgacccctcagaagtcatctatatggcataccatgcagcaagggcctggaaagcccagtcttgttgccatgcctgctactatgagatgcttctaaggaatcaggtggagggactagttcagccccacatgttgtatagatctgactggaagcagcaagaggttgtggcacgtgggcaaagatattttgaagaagttatcagaataatgtatggaccttgagagcttacttgggaggttctggcaggggagtgcagctactcatatacccttgatcaaagaatggtcctcctctattggagaaggtcatcctcttcaaccaagaacacagcttcaaaaaggtcgcacatagagtggtcaaggaggaaggggacacccgcctacccagccagatcagccgaatcaaccctggtgatcaatggggtgacagatgtcgcagctagatcgtcctcacatccaaaataatgtatgaattccatgaaagcaaagcagaagctttaaaaaatctattaggagcagaaagcacaatgcccaaaaggaaaaatgagaagaacttaaaggactttacccatttactgtatttcaaaggtcccgtgaatcccatggcttctattatctttgtgaaagcaccaaccttctcctcaacaggctgtggggaatctttggtagtagaaagctgattaaccaaaaagaaaaaaactaaaattagttgcaaaaaatttttaatagaatgctttgttcctcatcaggtctgagagcattttttttttaaatacagtcagggtctcctcccctcacccaggctaaagtgaagtggcacaatcatagctcactgcagcctcaaacttctgggctcaagtgatcctcctgcctcagcctcccaagtagctgggattacaggtgcacgccatcacgccaagtcaattttttaaattttctgtggaggtggggtccacagcctgttgttctctggagagggggggtccatagcctattgcctaggctggtctcaaactcttggcctcaagcaatcttcctgcttcagcctccccaaatgctgggattacaggtgtgagccaccatgcttgggctgagggcatttttattgcttagatttttgttttcacctacaatttttaattttcttttttttttcttttttcttttttttttttttttttgagacagagtcttgctctgtcgcccaggctggagtgcagtggcgagatctcggctcactgcaagctccgcctcccgggttcccgccattctcctgcctcagcctcccgagtagctgggacaggcacccaccaccacgcccggctaatttttttgtatttttaatagagatggagtttcaccgtgttagccaggatggtctagatctcctgaccgcatgatctgcccgcctcggcctcccaaagtgctgggattacaggcgtgagccaccgcgcccggcctaattttcatttttttaagcatcttatcattcagtgaaaacacatttggaactgtacctaatagatgccctccaaatttcagagcaagacatgcctacctcattgactgtatgtctattaacccatatctagcagatgacagatgtggggtattagaataaaagttctatcaaaaagaagacttttaaaaggaaatcttgacccccatctcccaagaacaattctgagaagtaaaacattctatgcttattgatgtaataggaaaaggaaaaaaaaatactgcctgaaagcagtcaaaagtcattcaaaactgcaatcaagcactgaatgtttttaaactcttgcattttttagtaaaggtatcacaaattttattaatgactacagagtcttgtagtttgcaaataacctccaaggaaagtctgttctaatgttaaccctctccaagcaaaggcaagctatctaaccaataaaaaattatccaaaagttaaatatcactttatttttaacatgtaaaaaattcatatgttttcctcttaagtgttttccagacacaacaatggaagaaacataggacatagcctcagaaggcttaggtccaaatattcaggctggcatggtggctcacacctataatctcagtaatcccagtactttgggaggccgaggtgggaggatcacctaagcccaggagttcaaggcagtagtgagccatgatcatgccactgcactccaccagggtaacagagcaagacctcatctgttaaaaaaaattttaaaaacaatcccagcacttagggaggctgaggcaggaggatcgcttgaagccaggagtttgagaccaacctaggtaacaaaacgagaccctggtctctacaaaaatttaaaaattggcagtacacagtggtgcatgactgtaagtctcagctattcagaaggctgaggcaggaggatagctcgagcttgggagttcgagactacagtcagctatgaaggcaccactctactctagcctgggtgacagagcaagaccttgtccctgaaaaaaaaaaattcattttgtctgccacttacttaccatccttgtgaccttgggcaagtcactttaccccctgagcctcaccttctgcattcgctaaaactcacctagctaacaattttgttgagatccaaagaacacctgtgtgaaagcactctataaacacagaatgcactgataattctcaccttacgtgtggtgtgatacttcctattcagctgtatgtctattccaggaatctgttctgatccaccacatgctcgggactggctcatctggggccactgaagaataaaaacacagatctatgcaacactgagcacttacagggttaatctgaacagagctgtttcaaagtaaagactataggatctttccaaccttacttagcccacttccccgtgatcagctcaccaggaagacccaagatcagcacctagaagggtgtctagtacatggtagatgcccaagaaatatctgttgaatacctgaagaaataaaagaatttgggccaggcacaatagctcacacctgtaattccaacactttgggaggtcaaggtgagaggattgcttgaggccagagtttaagactcagcctggggaacatagcaagactctatttctacaaatttttttttaattggctgggtgtggtggtgcatgcctatagtcttaagctgcttgggaggctgaggtgggaggatcacttgagcccagaagatcgaggctgcagggagctatcatcacaccactgcacttcaacctgggcgactcagcaagagcaagaccctgtctgtaaaaaaaaaaaaaaagagagagagagagtgaattcaaaggccaggtggcgtggctcacacctgtaatcccagcactttgggaggccgaggtggatggatcacttgaggtcaggagtttgagagcctggccaatatggtgaaaccccatctctactaaaaatacaaaaaattagccaggtgtggtggcacatgcctgtaatcccagttactcaggaggctgaggcaggagaatagcttgaactgaggaggcaaaggttgcagtgaaccaatatcatgccactgcactccagcctgggcaacacagcaagaatcggtctcaaaaaaaaaaaaaaaaaaaaaaaaaaagaattcagccctggaaacctggaactacatctaagtcaattctaggaaacagaactgtagtatctatctatttaaatatgggcagcagtgccgtatatggggaaaaaaataaagacaccagccacttttaggtttaaaacctgcttctgtcgcctacgacaagctcagtggccatggaaaacttactgaacctcagttgcagtaaggatgaaagaaggtaagatatataaagtgcctttcacaaaataggcactcaataaatagcagaagtttccatcatcactatcatcaccagcattattgtttggatcacaatcgccacctttttcatgttcacattgcatttaaaaacaatttggcaataaaatagccgttattatgtgccagatactatacagaatgaaaactgggaggaaagtccattaaggagatggttaatgaaagttcagtcactcagtggaaaatcaggtatccattgagggttttttgttttgtttttgttgttgttgttttgtttttgttttttgagacaaggtctggctctatggcccaggctggagtgcagtggtgcaatctcagctgactgcaacctccacctccccggctcaagcaattctcctgcctcagcctcctgagttgctgggactacaggcatctgtcatcacaccctgctgatttttgtatttttgtagagacagtgtctccatatgttgcccaggctggcctcaaactcctgggctcaagtgagtgatcttcctgccttgaactcccaaaatgccttgaactcccaaaatgggactacaggcatgagcctgggtgcctggctgggatttttttttttttaaatagacttttttttttttttttaacagcagttttaggctcatagcaaaacttcctggaaagggcagagttcccacataccccttcccccacatgcacagcctcccccgccatcaacatcccataccagagtggtgcatttgatacaaagaacaaacctacactgacacatcatcatcactcagactgcacggtttactcagagattattattattgttaacaacatgaaaaatgttaaatgcttataatatgtataaaattataggtaaaacatgactgcgtagactgcatatgggcaagtttagaaagaacacacaagaaaccaaagagttattttgttaagttagaattatggataaatttaagaatctatagccaaaataattctggcaaaaaaaaaaaaatctagtttccaaactctcactaatgctatattacctttacaataaaaaagggtgagagggagcaggaagagggctgactcttcaattctggtttattccaagaagaaatggaacacatggaatgaaaatgattttttttctttaaccctaacgaagaaaaaatagaatttctaattgtggaatgttactatttacttttctttccaaacgaggatattaaaaaattagtcaggattcttctggtcagtcccaaggacacttaggctttaattcataagtatcaagcaggctttgtaaaacacagactaaacacagaacacctccccattacatcacatacatcaatgcaatggtccacctaaaacacaaagcacttaaactggttcaaagaacacagccaacagcagtttccacaagctgtgctttgggctgggtcctcttctattaggttctattagatccttctttttcctcacagctctaggagtaaccagtagattccttctgtggctgtcctaccatctactgtatttctatcctaccattagctaacatttcacactatattgaactactaaagtacctatgtatctagtatcaaggacatctagtttctccacacctacacacttataaacacacacatttacttttttgtactacccactcttgtccttgcacttcccgcaaaaaattcactcgacccttaaagacctcaatttttcctttgcttagattagaaaatatcaataggctgggcgtggtggctgacgcctgtaatcccaacactttgggaggccgaggcgggagggttgcctgagtccaggagttagagaccagcctgggcaacatggcaaaccaccatctctacccccctccaaaaaaaaacaaaaattagccaggcatggtggtgtgtgcctgtaatcccagctactcaggaggctgaggcaggagaatcgtttgaacccagaaggcggaggttacagtgagccaagatcatgccactgcactccagcctgggtgacagagcaaggctctgtctcaaaaaataaaaataaaaaataaaaaaacaagaatgacagaggcagagaagtagaaagggggtgctgggacaaactcaagcgattcttgaataccatgggcgtgtgtgtctgctccttttagcaactataagctccagggcacagcccatcttatatgtctgtcattttctgtcccaatactcaacaccattctgggcatgaagtcattactcaataaaaactaggtggattttttttttttttcaaagaggacaactttggagaacgtccaaaaaaagaaccacaggaatgatcaaagggatgaataaaaggtcctagtggaaaggtcaaaaggaatttaggctgtttagcttggagaaaaggcaactgaagaactaaagagtaactcagaataacaacacttgagctggaagaaatctcagagatattctggtccaaccttttcacttcacagatgaggaaactaagacaaagggagaggttgcaatttggtaaaggtaattttaggacaacttttttttttttttttaagtttcatttcatacagtgaggagaaaactttcccaagcaacaggaacataaatagcaacaaaaatagcaattgcaacttactgaagatctcctgtatgtctagtacctacctacatgcttggtgttttacttatgttatctcacaacaatcttataaagtatattttcctattttttttttttttgagacggagtctcgctgtgcccaggctggaatgcggtggcatgatctcggctcactacaacctccacctcctgggttcaagcaactctcctgcctcagcctcccaaatagctgggattacagacgtgtgccaccacgccagctaatttttttatttttttagtagagacagggtttgaccacattggccaccctggtctcaaactcctgacctcaagtgatcagcccaccttagcctcccaaagtgctggtattacaggcatgagccaccacacctgccccttctatttctttttttctttttttttgagacagggtcttgctctgtcacccaggctggagtacagtggtgtggtcatgggtcactgcaactttgacccccccagactcaagggatcctcctgcctcagcctcctgagtacctgggaacacagagatccagctattccggattttttgtagagatagggtcttgctatgttactcaggctggtctcaaattcctggcctcaaacaatcctcccaccttggcctccagaagtgctgagattacaggcatgagccactgtgcccggactattttttcctgttttagaaattagaacacaaaggctcaaagaagtaaagttcattaaagactaggatatatactcaaagctatgttctgtccgctatatcaagctgccttcaaaagtctgagtagagttcaacaacacaggctcatgcacacttaatacccagatcttgatttctaaatactgctctccaatagaaggaatcggggctgggtgcggtggctcatgcctgtaatcccaatactttgggaggctgaggcgggaggatcacctgaggtcaggagttcaaggctaacctggccaacatggtgaaaccccttctctactaaaaaatataaaaattagctgggcgtggtgtgtgcgcctgtagtccccagctactcgggaggctgaggcaggacagtcacttgaacctgggaggtggaggttgcagtgagccaagatcgcaccactgcactcccacctgggcaacagagtgagactccatctaaaaataaaaaataaaaaaaataaaaaaataaaatcaggactccttggagtaatgtttgaatctagggccagggcaaagaaaatacagcatgaacctgaaacatcttgtggtgccagcaattaagagagtattcaaaaaatgatggggggcatgtagaaaggcgttcccaatagcccaagctgggacaatctaatcaacaaaataactaattggaaaatgaattataagccgggtgcttataatttgcacctctctttgggagaccgaggcgcatagatcacaaggtcaggagatgaaggccatcctggccaacacggtgaaaccccatctctactaaaaatacaaaaattagctgggcgtggtgagctcgcacctgtaatcaagctattcaggaggctgaggcaggagaatcacttgaacccgggaggcggaggttgcagtgagccaagatctcgccactgcactccagcctgagtgagagagtgagactccgtctcaaaaaaaaaagaaaagaaaagaaaagaaaatgaattataactcagaagaaaataaatatccatgagctcatactggtataaataaataattgaataaataaataaatggggaagaagtgacagctctttcttacaacagagttccagttaataaatgtaggaatgatggaaataaaaaatcattagacaaacaccacaataatgatcactgcagtgaagaaccatcaatgcaattatcatataatccatcaatcctaattctgggtatatatccaaaagaattcaaagcaggatctctaagatatttgtacactgacattcactgcagcattattcacaataatgtgtgcaagagacagaaggaacccaaatgtccattgatccaaatggataaagaaaatatacaatagaagagtacgcagccttaaaaaaagaaggaaatcctgtcatgtgctacaacatagatgaaccttgaggacattatgctaagtgaaataagcatgtgccagttataaaagaacaaaaactgtatgagtccactcacatgaagtatcctaaagtagtcaaaatcacagaaacaaggccagggtgatggctcatgcctgtaatcccagtgctttgggaggctgaggcgggcagatcactcgaggtcaggagtttgagaccagcctggccaacacagtgaaaccccgtctctactaaaaatacaaaaattagccaggcgtggtggtgagcacctgtaatcccagctactcaggaggctgaggcagaaatgcttgaacctgggaggcggaggttgcagtgagctgagattgcaccactgcattccagcctgggcgacagagtgaaactccgtctcaaaaaaaaaaaaaaaaatcatagaaacagaaagtagaaaagcagggtggggagagaattagtgtttagcatagagttttgcaagatgaaaaagtttatagagatctgttgcaaaacaatgtgaatatgcttaaattaacattactgaactgtacacttataatggttatgacaataaatttaatgttaacatatcattaaaaaaaaccaccaatgactgctaaaattagtaagcaaaagtataatgtgaaatgggtatctgcacagtctccaagtatctcctgacaagatactaattacaaagggaaaatactaactttagagttcaggaacctgacaaacaccaatttaaccaagtggccaaagttataagacctactagcattatgtatcccctgatatgatgcactgagaagggaataacatcatttttgccaaaaatgcataacctcaatctcattataagaaaatattagaaaggccgggctttctatattataggtggtagctcacacctataatcccagcactttgagaggtcgaggtgggcggatcacctcggatcaggagttcaagaccagcctggccaacgtggcaaaaccccttctctactaaaaatacaaaaagtagctgggtgtggtggcgggcacctgcaatcccagttactggggaggctgaggcaagacaatcacttgaacaggaggcagaggttgcagtgagccaagatcgcaccactgcactctagcatgggtgacagagcaagactctgtctcaaaaaaatgaataaaaaataaaagaaaataaagaaaaaagaaaagaaaatattacacaaactcaaattgagaaacattctacaaataactgactagtactcttcaaaagtgtctaaatcttgagaagaaaaagaataagaaaatgtgaccagacacagtggctcatacctatattcccagcacttggggaggcccacaggggtggatcacttgaggtcaggagtttgagaccagcctgttcaccaaatggtgaaaccccgtctctactaaaaatacaaaaatcagccaggtgtcatggcacatacttgtaatcccagctacttgggaggctgaggtgggaggatcgcttgaacccaggaggtggaggttgcagtgagcaagatagtgccactgccaagatagtgtcatccaccctggacgacagagtgggactctgtcttaaaaaaaaaaaaatgaaaatttaacagattggagacgactaagaatatatgacaactggatttgttatcgcagatcaaaaaaggacattcataaaaaaaaaaattgacaaaattggaacaaatagactaattaatagtattatttcaatgttaatttcctggtttcagtaattgcaccatggttatgtaagaggttaacattaggggaagccagatgaaggctatttgggaatgctactacttttacaactcttacataagtctaaaattatttcaaaatttaaaaaatatttttaagtagacagaacttcaagaggctaattaagacaaagctgaaagtatgtctctagctctttgaaaacaataataggattacagcactggacattaccttacagatacctgatactaccactcatcgaaggaaggattcctttatgtcaggcccttgacatacattcatcctaccactgcctgaatatttccagtaagagtaaatttactatgtgaaaacgcagctcacacatcccattatgcacaattctaattaacaaaactctttctcattctgagccaaatcttcctccctgtgagacatgtacctgaggatgccattctgaagcagaagtttccaaccaggggacctcaaagataggaagatactccagtaagttacagtcgatacgacaaaaggtccagttgatttacaatgactaaaattacatctggtcagcatgagataaaccaccctcagttatttacataaatgctttgctataatgttgtcccagagcctaatacagtacccggtacttattaggtgctcaagaaacgtttactgacccaaagagtagggcacaagtcagagattcatataatgagttattttcccctaccatctacacacatacaaataacaaatactattaaaaatttgtacaaaaagtaacagaacacagcccaagctctgaaaagaaatacctgcataactacccaaagtagacgcctcttctgcacaggcatattctccattcattcaacatatacttagtgactactctgtgccaggcatagtgaaaagaccaggaaatacaagaaaaaagcaagatgtcctcagaagggcagggcttacacattaattggagggaatttttaagtagattatatatgttacataaattatataatatatataattacatatagcaaacatatttttaattgcatcgaatacgaaaaagaaagttaatgactacagataaaaatcataaattggtaagaaaaatgagttcccaatagatgaatggagaaatgccataagcatacaattttcacaaactgaaaaacaactgatcaatacagaaaaaatacataaccctgagagctaaacaaagaaatacaaggtaaaacaaggtaacatttcttacccaatttatttaagttaaaaaaaactcaacttgagagaggtaataatgaaaaactacttatacatacattgctggtggcagcataaattaaaacaaccttttgaagaggcaaactgttcatactctgacccaaggtatgccttcctaggaattattaataagtaattaaaagtaagaaaaaatatgtgctaagacaatggtaagaaaattaaagcttataatggcaaaaaaaaggaaatgattttcatatcaaaggctaagtaaataaaatattatatggtcattaaatttttaattacaaagtctatcaaaacaatatgaataatgtccactctaataagtgaaaaggtaccagaatataaacttctgtggacatttgttagggtacttcaggaataacattacatatacatacacacacacacacacacaaacacacacaaacacacacacacacacacacacacacacacaggctgaaaaagaaccagcagagataaaatactgacgttttcagatttgaagtcatagatgatttatttcccttattactaaattatttgtattattaacaaaaatcaggagggacacaaggtccaaggtaaactacattataatgattaggtggtcaatggtaaatgaatacctcaaataattgtttcttggattttatattcatataaaggaaaaagaaataattatcacgcccaaataaaagtagcacaagatggccacaaaaagaaaattgaaaaaggttaactcggagatgaatatctggaaaaattccctaacagtaaaaatcatcagactgtagcatggtatcctaggctaagttccactgctagggtatttagaagcaacgccctagacaccatactttaggaatcagtcctaagttggcaccacagagacccagagtggtctcatgaggtttttccatcacacaatttggttggctaatctataaatacatgacatttgcacataaacactaaggttttcatactaagcaaaagaacaacaaatcttacctgggaagtgcgagacagagccctgtccccctgtccttgggtaggagacacaggtatcaatcggctgcatactggaacccactgagaaatgctagtctggttcctctaaagaaagaaaataataatctgtcaggaatctaaatcatactccctacatggaaggcaaagagtgtacctgtgatactgtaatataattagaaatatatatttggccttcatctctagttcctggcacagagctcctaaaacccttggaatttctgagtgaggggggtgtctgtaactcataataagcccctttcaaccatacctgagtttatgctaatgaggtgattcatgcaggatggaggctggttgccagagaaacctaccacaggagtagagggttggaactcagccccaactcctcaaggcatccccacctccaggagaggagagggattagagactgagccaatcactggtacccagtgatttaatcaatcatgccaacaataagcctccacaaaaattctaaatgacagagttcagagaacttccggtaaagatgaaaaactcttttttctatactcaacactccacttctgataccaaatgtgcaggggcaaggggtctccataccaagcaattctctagttctctgcagacaccaactgggtgtcctacaatttaacttaattcttaaactaactgcctggagttagcagagacctcacagcaccatccaacaggactgtcccccacttcagactcccatcacaagtagtgggtccccaggttactcacacttttgtccaacttgtccatacattgggggttcccacagctgcctcctcagattcaataatttgctagcatggctcaactcggggaggcacttcacttacttttatcagtttattataagggatacacctcaggaacagccaaatggaagcgatgcaaaagacagggtacggggtgggagcttgctctccgggtgtgccaccctccctacactttgatgtgtttactaacctagaagctctccaaacccagggatttctatggaggcttcattacgtagacatgattgattatcactgatcactggtgatcagctcaatctccagcccctctccccttccaaaagtcagggaggagtgggagaagctacaagttccaaccttctacacacatatttgttcctctagcaaccagcctctaccctccaagagtcaccttattaacataaactcactgccggtcatagcagctcatgccttcactcctattatctcagcacttttgagaggctgaagcaggattacttgaagccaggaggtcgaaaccagcctgggcaacaaagcgagacccccagctatacaaaaaaaaacccataaactcatgtatggttgaaaggggcttattataaataaataaaaaaaaaaccattcctctcaccccaatcactctgcaagggtttcaagagctctgtgccaggaaccagggataaagaccaaatatatatttcttctctcacaatatcatatctgggttgcagccacaggccaggagggtggcacactctaattccacagggacagaagcaactacactcaggaccattccagatctggcctttagtacctaagtttaaaaatcctgccagaatggggtatcacatgaatgaagaacttccaaaatgggaccaagaccaagcctccacatgctcatttctccaaggataagataaaccactgcctactactgattccacagactaaaataattctggtaataggtgactcaagcagtgggcacgggctccctctgggaagagaaacaaaataagcagacttctggcattttatgattagattataattcaaattacggtttgcaatgtcttttttttttttttttttttttgaggctgagtctcgctctgtcacccaggctggaatgcagggccatgatcccagctcattgcaatttccacctcctgggttcaagcgattcttacgcctcagactcccaagtggctgggactacaggcatgagccaccacatagggctaatttctgtatttttagtagagacagggtttcaccatgttgaccaggctggtcttaaactgctgaccttaagtgatctacctacctcggactcccaaaatgctgggattacagatgtgagccactgtgcctggcctttttttttttttttttttttttaagagacagggtctcactacattccccaggctggagtccagtgcctagtcatggtgctaacattgcacactacagcctcaaatgcctgatgcctgggctcaagtgatcctcccacctcagcctcccaagtagctgggactaaaggcttgcatagctgtgcctggcttacaatgtgttttcataaacactgacttacttacctgatcttcatagaatccctttatagtaagcaatgctgagatcatcatcatccccaaaaggaggaggaaactagggtagaagttttgcagtgggaaaacacacgtgggcaacttgatttccaagacaagagagattaaatggctgttcaagctaaaactgagattcacgttttccctctaacatgaagctcacttcagaaaggtctcttggccaaagtgagaggctaggctggagaaagggatagctctctcttgctaaataagaagtctgctttattttatgaacctgaaatacattccactgtataaatgatagccatgtacacagcactggaaatcttaattttaggaaccaactctagggatctgagggttttcttcacttgacctgtagaccttatagggccataatgaggaccagatacataaattgcttgaaaatcctttgccaagcataatgtataacacagtcagccctccacagccatgggttctgcatccatggattcagccacccacagattaaaatattcaggaaaaaaataccgggcatggtggcgtgtacctgtagtcccagctactctggaggctgaggcacgagaatcacttgaacccaggaggcaaaggttgcaagtgagcagagattgtgccactgcactccagcctgggcgatagagagggagactctgtctcaaaaaaaaaagaaaaaaaaaaaaagaaaaatcaggccgggcgcggtagctcacatctgtaatcccagcactttgggaggccgaggctggcggatcacgaggtcaggagatcgagaccatcgtggctaacacagtgaaaccccttctctactaaaaatacaaaaaaattagccaggcgtggtggtgggcgcctgtaatcccagctactcaggaggctgaggtaggagaatggcatgaacccgggaggcggagctggcagtgagccaagatcacgccactgcactccagcctgggtgacagagcgagactgtctcaaaaaaaaaaaaaaagaaaaaagaaaaaaaaatcaggaaaaaaacatgccatactaaacatgtagactttttttttctcgtcactactccctaaataatacagtataacaactatttacatagcacctatattgtattaaatgtaagtaatctagagattatttaaagtacatgggggaatatatataggttatatgcaaatactatgccactttgtatcaaggacttgagcatccacggattttgctatccgagggaggtcctggaaccaaaggaccagggatacttggggacaattgtactaggagtcaaagattctagtttaaattcagctactctaacattatctttacaagtaatttaacctctgtgacattcagtttcctgatagcaattatgaggaacacttaatgagcatttgatggcaggcacttttctggtactttacatatatgaactcatttaaacttcacaatcaccactcatgtaggtatatcattatcccatttacacaaaaaaggaaactgaggcatggagaggataagcaacctcccaatgtcacatagttctaacagcaggattaagatatgaacccagacaacccaactctagaatccttgctcatttatgggatgaaagggtagagtatctgcaaggtaccttctagctctaacactatatgacctggtctggaaccaattaaaacagcatattgtggaaagtgccacataactaaaggcaggaagtactgttcagaagctacatattagataatcacctctgtgagccttggttgtctctttttatcaaaaataaagacaaaatccccacttctcaggattttctttaaaattaacaaatgtaccttgcagtatgttcagcacaatattaagttgaatctgaatctccatttcctcgagtagaaacaggttgaggtggggtggagaaaggcattaaatttttaaacctacagatgctttctaaagtgtctcacagttctaaaattgtataattgccacttacagcaccttaaatttcaaatgaaaagtggagctaaaaatattttatttgagctgtggttggatcagttgaaatggttttccaagtgagagacagttactggtgttttgttttacaaacactgacagatttaccagaaacattcaatgtcagatgttcctgtactaaaaatgttaactatgggataagaggaaactgcttcagattcagggccaaaggtggggggggggggggggcggtgcagggggagcaagaggaaattacaagttgaaacaatgcaaacttttggaagattttctgaagaatttcatcatgtaatttccaatgtcaacaaaacttttctctgtaattttggctccggttggtcttaggccaatacttttaaatcagttcttattagaagaaaggaacaatcagctgttctttccttcgccaatcctacaacaattcttgtccaaatccttaattgaaaccactgaagtgtaacagaaagggtaatcccaagtctgccatcaaatagctgtgaactggttactcaacaatctgggcctccattttcccttatgaaaaatgggaataataaaagctatctcacaggagtgttcccaggaacattcctaaaagcactttgataacagaaaaacacaactaaaggcatcactgttatgaacaactgttaccgaattatacaagccctgctttccccagcaaactgccagagaagcaaaaactgttttcttaaaatattgtttggaatctggcatttattccctttctcaaaagcttgcagtggtttccaaggacctctttattgaaacttaaacacctggtccttactggtctttaccaactggacccctctaaactcataatacttactgtgttttccactcaacagtttcaacacctgactcagattctctggtttgggaatcactgcttcactccacacatgctaatttccttgtagtaattttttgggactctcctcttcactccaacccaaactataagctcaattgcttcaagaaatctctctaggccgggcgcagtggctcacatctgtaatcccagcactttgggagaccataggcgggcagatcacctgaggtcaggagttcgagaccagcctggccaacatggcaaaaccccatctctactaaaaatacaaaaattagccgggcgtggtggcaggtgcctgtaatcccagctactcgggaggctgaggcatggagaatcgcttgaactggggagacagagattacagtgagccaaaatcaggccactgcactccagcctgcgtgacagagcaagactccactcaaaaaaaaaaaaaaagaaaagaaatctgtctagatgtcagcttctggttctactggctctactcagtccttttttttttttttttttgagatggagtcttactctgtcacccaggctggagtgcagtggcgcaatctcggctcaccgcaaccttcacctcctggattcaagcaattctcctgcctcagcctgccgagtagctgggactagagcggcgcgctaccacgcccagctaatttttgtattttcggtagaggcggggtttcaccatgttggccaggctggtctcaaactcctgatctcaggtgatccaccggcctcggcttcccaaagtgctgggattacaggcatgagccaccgtgtcgacctctactcgtcctttttcctttccacctcttccaccacttcatctataaatataaatctgtggaagtacttatctctctcttaaggtactaatatattaggcctataacaattagcacatctcaacttctcccaagttcaaaagacattcatagccactcccaatggcaaaaattattcctttaacttaagataaatgcactgttactaagtgagaactagttttattgccattttgcctttccaacacttcaaaaccaaaaaaaaaatttttttcttttttttttttttgagacggagtctcgctccgttgcccaggctggagtgcagtggtgggatctcagctcactgcaagctccgcctcccaggttcacgccattctcctgcctcagcctcccaagtagctgggactacaggcgcccgccacctcgcctggctaattttttgtatttttagtagagatggggtttcaccatgttcgccaggatggtcttgatctcctgaccttgtgatccgcccgcctcggcctcccaaagtgctgggattacaggtgtgagccaccatgcctggccaaaaccaaaatttttaagataggcttcatgttttcgtttcccgtgcacattgttaattgcagtgatttttacatcagtatttcaaaacattctgacataccacctcttgtactgactaccctttaatcagtccactgacaggcctgtttctgcatgtggttttttaagatacatagtattttccttggctcattcatgagctagaaaacaatttacaggtgtagcggattctagttattcaccataaaatcaccacaaacactgagttagcaaatactgaaccattgcttctaaaggaaatgccagacttaggttcctggaagcctctggtcacaacattcatcaaccaatcaatatataaccttgttttattggtttctgttgaaagacaccctatttaatatacattgttgattcattaacacggaactcacagccaacagcactataactcacttagcaaaatttacctaacaaacatattttcccataaggcacattgtggccttctcgcactcagcaatgctagatagcgtttccatactacacttgggtgacattttaaagatgggattcaccaacaaaagcacaaaaatacgaaaaatatggcactaaacaggccatgaaaagaatacttgttacagtatgaaaactgaaacaagaaggcggaatgttgacccatctcagccaggaacacacacattggcagctcaaatttcttacccctctgcaaatgtccacaagtgactacaaaagtgctgcaagtattgattttggggtttcaaataaattttagcaactaggtgagttcacaaatatagaatctgtgaataacgaaaatcaattataaacatgaaatccaccttttttttttttttttttttgagacagagtttcactcttgttgcccagactggagtgcaatgacgcaatctcagctcaccgcaacctctgcctcctgggttcaagtgattctcctgcctcagcctcccgagcagctgggattacaggtatgcgccaccacgcccagctaattttgtatttttagtagagacggggtttctccatgttggtcaggctggtctcgaactcccaacctcaggtgatccctcagcctcagcctcccaaagtgctgggattacaggcatgagccaccatgcccagccgaaatccactttataagtcaccactggtgcctatattccaaatgccatggatactaactcaattccggagtccaaagaacagatactacggtaacaaactttccttccagttacaatgtggcatgctataatacaaaaggatatttccacagagggaagaagagaatgtttaaccattccttcaaaaattactgaatacaggccgggcatagtggctcacgcctgtaatcccaacactttgtgaggctgaggtgggtggatcacttgaggtcaggagttcgagaccagcctggccaacacagtgaaacccgtctgtactaaaaaatacataatataggccgggcgcggtggcttacgcctgtaatcccagcactctgggaggccgaggcaggcagatcacgaggtcaggagattgaaaccatcctggctaacatggtgaaaccccgtctctactaaaaatacaaaaaattagccgggtgtggtggtgggcgcctgtagtcccagctactcgggaggctgaggcaggagaatggcgtgaacctgggaggcggagcttgcagtgagctgagatcgcaccactgcactctagcctgggcgacagagcgagactccatctcaaaaaacaaacaaacaaacaaacaaacaaacaaacaaaatatatatatatatataatatatataaattagccgggcatggtggcgcatgctggtaatcccagctactcaggaggctgaggcacaaggatcgcttgaacccgggaggcggaggttgcagtaggcagagatcatgctgctgtactccagcctgggtgacagagtgagaccccatctcaaacaataacaaaaaattactccagtactttgggaggccgaggcaggcggactgcctgagctcaggagtttgcaaccagcctgggcaacacagtgaaaccccatctctactaaaatacaaaaaaattagctgggcatgagggcatgcacctgcagtcccagctacttgggaggctgaggcaggagaattgcttgaacccgggaggcggaggttgcagtgacctgagatcgcgccattgcactccagcctaggggacaagagcgagacttcgtctcaaaaaaaaaaaaaaaaattacctatacactgcctcctcccacttttttgggagttttcaatctgagctttcaaaagattgattacatacaggaaagatttgaataaatcaataaatacattaagggtgaggggtcaggtttctatcagagaaaggagttaacaaatatggcaaggcaaaagagtagaacaaaccctgtggtattagaatagattagaataactggtgtgggcttttaatatataaagaaaaagatatatgcatgtttatgtgtatatatagacatatatatatttcctacccacgtcctggtagggcctgcagatgacactccagtagcaataagcacatgtagcacccagatgtggtttctaaatagcaacaaccactaaaggaactagtctcctcaggagacaagttgactccagaatggggatgatgttcatcaaagccttacaaagaactggcattattcccagacatcccattactgggtatatgcccgaaggattataaatcatgctgctataaagacacacacacacgtatgtttactgaggcactattcacaatagcaaagacttggaaccaacccaaatgcccaacaatgatagactggattaagaaaatgtggcacatatacaccatggaatactatgcagccataaaaaaggatgagttcatatcctttgtagggacatggatgaagctggaaaccatcattctcagcaaactatcacaaggacagaaaaccaaacactgcatgttctcactcagaggtgggaattgaacaatgagaacacttggacacaggaaggggaacatcacacaccagggcctgtcgtggggtggggggagcggggagggatagcattaagagatatacctaggccgggcgtggtggctcatgcctgtaatccaagcactttgggaggccgaggagggcggatcacaaggtcaggagatcgagaccatcctggctaacatggtgaaaccccatctctactaaaaatacaaaaaattagccaggcgtggccgggcgcagtggctcacgcttgtaatcccagcactttgggaagccgaggcgggcggatcacgaggtcaggagatcgagaccacggtgaaatgccgtctctactaaaaatacaaaaaattagccaggcgtggtggcgggtgcctgtagtcccagctactcggagaggctgaggcaggagaatggcgtgaacccaggaggcggagtttgcagtgagccgagattgcaccactgcactccagcctgggtgacagagcgagactccgtctcaaaaaaaaaaaaaaaacaaaattagccgggcatggtggcaggcgcctgtagtcccagctactcgggaggctgaggcaggagaatggcgtgaacccgggaggtggagcttgcagtgagctgagattgcgccagtgcactccagcctgggtgacaaagcaagactccatctcaaaaaaaaaagagatatacctaatgtaaatgatgagttaatgggtgcagcacaccatcatggcacatgtatacatatgtaacaaacctgcacgttgtgcacatgtaccctagaacttaaagtataaaaaaaaaagaagcttgactctgaaaaaaaaaaaaaaaaagaactggcattattcaacctgtctgacagttccttagaaggccctatttcaaggctgtcttagaactcacccagtgtgaaaaaaccttttccccaggagcaccggttgaaaacaaatagaggtaactgtttgacttcatggcttcctgaggcagtgattaacaggtggagaaaacaacaggctaaccaaaaaggtttaaaggaaaagctggggaataagatgtccacagaggcttagaaaagccccaatatattcctgggcatctaggaagccatgaacatacccaggtctgtgcatatacccaaagctgtgcacatgctcaggaaagacctaagaatgtctcttacttgtggttgaccttgaggttctgcatagcaggaagtgaaagttaaggcagagttatcgaatgcctggcagagtgttataggtacatcccaacgtgcacacagagccccaaagcaaaaactgggatactcactgcttccaggcagtgagaacagaattttaagaaatttaacagaaatttaaagaaatttgtttaatcattacctgaccactaagctatctaagcagagacttcagtagccacaaacaacaaagaatacagactacagaatcaattcagaaaagtcactaaacaaaaatacaacagcaaaccctgggaagggaaacaatctgatttccggagtggccacattatttaaaatgtccagttttcaacaacaaaaagttataaaacatgcaaagaaacaataaagtatggcccatacacagggggaaaaaatgcaatcaatagaaactgtctctaagaaaacccaggcagcagacaaagagatttttaactatttcaaatatgttcaaagatctaaatgaaaatatgtctaaagaactataagaaagtggccgggtgcggtggcttacacctgtaatcccagcactttgggaggccaaggcagggggatcacctgaggtcaggagtttgagaccatcctggccaacatggtgaaaccccatctctactaaaaatacaaaaattagccgggcgtggtggcaggcacctgtaatcccagctactcagaaggctgaggcgggagaatcgcttgaacccgggaggtggaggttgcagtgagccaagatggcaccaaagagaatatcaacagaaagagaagttatttttttaaagacaaaataaattctagaattgaaaagtccaacaactaaaatgaaaaactcattagagggactgaacagcagatttgaacaggcagaagaaaataatcagtggtcttgaagataggtcaatttagatcatccagtccaaggaacagaaagaaaaagcaataaagacaaattagtagcctcaaaatgaaaagcaaaaacaaaaaaagaaaaaaaagaacaaatttaacagcctcagactgtgggacaccatcaaacacaccaatatatgtataattagagtctcagaaggaaagaaaaggaccgaaaaatatttgaagaaataatggcagaaaacatcccaaacataatggaaaatggtaatttaggaatccaagaagctctactaactccaaataggataaacacaaagagagccacagacacatcatatgcaagctgccaagagacaaagattctttaaatgagcaagagaagaaactcatcatatacaaagtatcctcaagaacattaacagtggatttcttctcagaaactgtagcagccagaaggcagtgggataaaatagtcaaaacaaggaaagacaaagattttcaaacaagaattctatatccagcaaaactattattcaaaagtgaaggaaaaaatgaagatttcccagataaacaaaatggaaagaatttgtcagtagtagacttgccctgcaagaataaggcagaccttcaggttgaaatgaaaggaaactacagaataactcaaatctacatgaagaaataaagtagactggtaaaggtaactgtttaggtaaataaaaaatacagtacaaatggattttttgtttgtaattctttttctttttaatttaaaagacaactacaagaagaaataattataaatctacattggtagacatataatgcataaagatgtaatttagatgacaataacacaatgttcgggaaggaacagagctatatagaaagaaagtctttacatattactgaaatgaagttcgtattaatccaaacaagactgttatgaattaagatgttcattgtaatcccagggcagccactaagaaaacagctcataaaatatagtaaaagcttgtaacatgtacacaaattagctcaaaatggataaaagaccaaaatgtaggacctaaaatgatacaactttcaaaagaaaacttacgggaatggcttcatgacattggattttgcaatgatttcttggacatgatatcaaaaaagtaggcaataggccaggcatggtggctcacacctgtaaccccagcactctgggaggctgaggtgggcggatcacttgaggccaggagtttgagaccagcctggccaacatgggaaaaccccctctctattaaaaacataaaaattagccaggtgtgctggtgcatgactgtaatcccagctacttgggagggtgaggcaggagaattgcttgaacctgggaggcaggggctgcagtgagtctagattgtgccactgcactctagcctgggtgacagtgcaagaccctgtcaaaaaaaaaagagtgggcaataaaagaaaaaaaaataagttggacttcatgaaaatttaaaacttttgtgtatcaaagaatagtatcaacagactgaaacagcaacccataggataggaaaaatacatgcaaatcatatatctgatgagggattgatattcaaaatatatgaaaaacttgccagatgcagtggctcatgcctgtaatccttgcacttcgggaggccaaggcgggtggatcacctgaggtcaggagttcaagacccgcctggccaacatagcaaaaccccatctctactaaaaatacaaaatttaaggctgggcgtggtggctcacgcctgtaatcccaggattttgggaggccgaggcaggcggatcacctgaggttgggagtttgagaccatcctgaccaacatggggaaaccccatctctactaaaaatacaaaattagccaggtgtggtggtgcaggtctctaatcccagctacttgggaggctgaggcgggagaatcacttgaactcaggaggcagaggttgcggtgagccgagatcatgccattgcactccagcctgggcaacacgcgtgaaactctgtctcaaaaagaaaaaagacatgaagaagtgcccaatatcactagtcactagagaaatgtaaatcaataatacaatgagacaccatttcatactcattagaatggcaattgtcaaaaaacagaatataaggccacgtgtggtggttcacacctgtaatcctaacacttcgagaggctgaggcaggagtatcacttaaactcaggaatttgagaccagcctgggcaacatagcaagaactcctctctactaaaaatttaaaaactagctgggtgtgttggcacacacctgtagtcccagctactcgggaggctaagatgagaggattacttgagcccagaagtggaggctgcagtaagctgtcattgggccactgcactccagcctgcatgacacagcaagaccttgtctcaaaaacaaacaaacaaaaaccagaaaataacaagtgttggcaaggatgtggtgaaactggaacccttgtgcactgctagtgagaatgtaaaacagtgtatctgctgtggaaaacagtaggacaattcctcaacaaattaaacaggctggacatagtggctcacgcctgtagtcccagcactttgggagaccgagacaatggattgcttgagcccaggagttcaaggccagcctgggcaacataaggagaccccatctctacaaaaaagaaaaaaaaaagtagccaggcgtggtggcacatgcctgtggtcccagctactcaggaggctgaagtgggaggatcacttgagcccaggaggtcaaggctgcagtgagctatgattgagccactacacttcagcacgcatgacagagcgagaccctatctccaaaaaaaaaaaaagagaaaattctgacacatgctacaacatggatgaatcttgaggacattacgctaaatgaaataagccagtcacaaaaggtcaaatactgtatgattccacttatatgaggtacacaaagtagttaaactcacggagacagaaagtagaatggtggctgccaggggctggggagaaaagactatagagagttattaataggttcagagtttcagttttataaaatgaaaataattctgtggataagggtggtaaagatggcacaacaatgtaaatgcactcaataccacagaactgtacacttaaaaagtttcaaaggtggccaagcacagtggctcatgcctgtaatcccagcactttgggaggccaaggcgggcagatcacctgaggtcaggaattcaagatcagcctggctaaaatggtgaaaccccatttctactaaaaatacaaaaaattagctgaacgtagtggcacgtgcctgtaatcccagctactcaggaggctgaggcaggagaatcgcttgaacccgggaggcagaggttgcagtgagccaagatcacgccattgcactccagcttgcgcaacaagagcaaaactccgtctcagaaaaaaaaaaaaaagtttaaaaggtaaattttgttacatgtattttaccacaacttttttttaattttctaaagtacagggtggctttctgcaatttttactatttccaaagaaaagcagaaatgatcagcaatgcccaggacaactcataaaaaccataagcatgtccagttccactgatcaaatgtccaggctctctgctgtagtcattcaacaatagcagtgttttagtttcctcctccttcccaaaaccatcactggagaagggaaaatattggctgacaagacaaaaagaggaaaaaataaagcaagactaacaagaatgtttcaggaatacttctttttttttttcagacagagtttcactctttcacccaggctggactgcagtggcacaatctcagctcactgcaacctccgcctcctgggttgaagcaattctcgtgtctcagcctcacgagtagctgggattacaggcgcccaccaccaggcctggctaatttttgtatttttagtagagacagggtttcaccacgttggccaggctggtcttgaactcctggcctcaagtgatccacctacctcagcctcccaatgtgctgggattacaggtgtgagccacggcacctggccaggaatacctctctgtggttcagttttcttatctgtaaaatagaggaaataacacgccctcctttccaaagggatgttataaggattaggtaagtattttaaagtgcttagcacgtagtaagtgccctataaaatgatagttgtcaggccaggctcggtggctcatgcctgttatcccagcactttgggaggccgcaggaggcggatcatgaggtcaggagttcgagaccagtctggccaacatggtgaaactccatctctactaaaaatacaaaagttagccaggtgtggtggcaggcgcctgtaatcccagctacttgggaggctgaagcaggagaactgcttgaacccaggaggcagaggttgcagtgagccgagatcacaccgctgaactccaccctgggtgacagagcgagactccatctcaaaaaaaaaaaaaatacaaaaattagtcaggtgtggtgtggtgcatgcctgtcatcccagctactcgggaggctggcacaggagaattgcttgaacccgggagcagaagttgcagtgagcccgagatggcaccactgcactccagcttcggcgacagagcaagactctgcctcaaaaaaaaaaaaaaaaaaaacaaaaccctaaagggtggcaggggaaggattaaaaaaaaaaaaaaaaaaaaaaccactaaattcagaacattctaattgccatttccccagcagtcctcatttctgaatcaatttctggcctgaaatcaaacaatcacttcaccaggtgaatctttctggcagttacaggggctactctacaaataaatatttactgaacagcagtcgagggtacctcactctgctaggctggcaaggaatacaagaagtaaaactgtcgtccttgtaagacatatataaaaagatcaaaaacacaaatgtaaaataacaattcagaagttacctagacacaggaatagaccatgtctactatgaaaaacagtgtctttgacccagtttttgaagactcgctaaaactatacactctcccatccctccatgattaaaaactaagctctgtatcctaacgttttttctgctgccactttcttttctcctttaattgctagagaaaagagtatgctagaagggtcaggactaaatctcaagaggtgcagtagtttcacacacgggtgctaaagagtctggtagtctttccttacttcattcatttattcaacaagtaatcatttaacacctatgatgtgccagacaccatgctaggcaaagtgaaaacgacggagacagacatgactccaattctcacgcagctttcaatctaataatctatattccacttaactgtacagttaagaactgacttattacctatgaaagaaaccctgagaatctcagaatctaaagggactgcaggagataaatgtcctcgtttttcacatagggtcaatgaggcccaaaagtgacttgcttaaagtcactatgcatcagtgacagtcagggactagaacccaggcctcctgaaactccaatcagtgtcctacatgctcctctccctgaggggaagcaggtacatgggggagggaaggaaaagtaaaccccatcaaataaaggccagatgtcagtcttccccttctcgaaagatgggggagctaaggtcaaaacggggtaggaagaggtcggaagctgcctcagtttccccacggaaaagcggccactcagcctagctataacacaggcttccctcctgcgattccttccaattcctcccgccctgccttgtcgaactccaacccgggacccagagagctaccgtagaaaattactccttcactcacaaggactcgcaccagcaacgccatgttcctcaataaccatttccgggtgaagagtgagtttccggtgtccccttttctacgtcctccttttgccggcgaaagactggcaaggggggcgcaggcgcaaagaggtcgctacgcgcacgcgctgttgttttctcggctgtgcaccaggctgtcgtgcccgggcacgctctccctgctgtctcccccactacacgtaacagtggttcaaatccttcccccacgcctgtctccttgaccccagacctcggggcttctcatatccctctctttattccccacctaacccagcctcactcctcagcccctccttcccaaactccaccccaacacttttcaatggaggttgaaaagaacaggactttaggaaatcccaatctttagaaagagccagaagaccgggcgcggtggctcacgcctgtaatcccagcactttgggaggccgaggcgggcggatcacctgagatcaggagttcgagactagcctggccaacatggcaaaaccccgtccctaactaaaaatacaaagaaagtagccgggcatgttggtgtgtgcctgtaatcccagctactctgaaggcagaggttgcagtgagccgagatcgcgccactgcactccagcctgggcgacagagcaggactggactctgtctcaaaaaaaaaaaaaaaaaaaaaaaaaaaaaagccagagaaggaggctaagataaaagaatacgggggataccagactcctgaaagtcaaggcaagaaggcggtcatgtgccgatctgaagcctggtagaggaagaaacttttgggatttgtggttggttggttgtttaagggaaacatctttgcatattgataggaaaagattagtgaagagtatacagggccgtgcccggtggctcatgcctgtaatcccaacactttgggaggccgaggcaggtggattgcctgaggtcaggagttcaagaccagcctgaccaatatggtgaaaccccgtctctactgaaaatacgaaaaaaattagccgggcatggtggcgtgtgcctgtaatcccagctacttgggaggctgaggcagggaatcgcttgaacccgggaggcagaggttgcagtgagctgagactggggcactgaactccagcctgggtgacaaagcgagactccgtctcaaaaaaaaaaaaaaaaaaagagtatacaggagaatcaatcaaagaggcaaggagcttcttgaggaaagtggcagagaacggccttggtagaagactcctcttccattacatcccaagagaagagaagacaaagtactggtgctttgggggttgagggagcagaggggcaggatgttgaaggacttctttcatttcattcagtcaacaaagacctattgagtcttccctatgtgctgaacacaagacatactggcttcatggagttcttagactggtgggggaggcataggaacccagtgaaaaaaattaaaactggggagctactttggttaggttggtaaggcctctccaagaaagtgacatgtaagatgaaatctaaaggaagaagaggagctagtcatgggaaataacttcactcgactatttttttaattaaatttattgatttttattaattgacaaaaaatatatattgtgtacaacaggatgttttcttttttctttttttttttttttttgagacagagtttcactcttgtcgcccaggctggagtgcagtggctcaatctcggctcactgcaacctccacctcccaagtcaagcgattctcctgcctcagactcccaagtagctgggattacagatgcgcaccaccacgcctggctaatttttgtgttttcagtagagacggggttttgccatttcggctaggacggtctcaaactcctaacctcaggtgatccacccacatcggcctccgaaagtgctgggattacaagagtgagccaccgtgcccccggccaggatgttttaaaatatgtatacattgtgaaatggctaagtcaagctaattaatatatgcattacctcatatttttgtgctggaaatgtttaaaatatgttctttaagcaattttcaagaatacaatacatattcatagtgggtatagtcaccatgttatacaatagatcttttctttttttttttgagacggagtttcactcttgttgcccaggctggagcgcaatggcgtgatcttggctcactgcaacctctgcctcccgggttcaagtgattctcctgcctcagcctcctgagtagctgggattacaggcatgcgccaccacgcccagctaatattatattttagtagagacggggtttctccatgttggtcaggctggtctcgaactcccgacctcaggtgatccgcctgccttggcctcccaaagtggcctcctgaacttatctctcttaactgaaattttgtatcctttgacaaacatctcctcagcctctagtaaccaccattctactctctacttctgtgtgttcaacttatattccacatatgagagaaatcaagcagtgtttgtctttctgtgcctcatttatttctcttaacataacatcctcccagttcatccatgttgtcatagatatgagcatttccttcttttttttttccttgagacagagtcttgctcttgttgcccaggctggagtgcagtggcacaatcttggctcactgcaacctctccctcccgggttcaagcaattctcctgcctcagcctcccaagtagcctggactacaggcatgtgccaccacacccagctaatttttatttttagtagagatggggtttctccatgttggtcaggctggtcttgagctcccgacctcaggtgatctgcccaccttggcttcccaaagtgttgggattacaggtgtgagccaccgcacctggccagcatttccttcttcttttaggctgaatagcattccattatatatataaatcacttttttttttttttgagacagagtcttgctctgccgcccagggtggagtgcagtgacacaatcccagctcactgcagcctgtacctcctgggttcaagcaattcttgtgcctcagtctcccaagtagctgggactacaggcacgtgccaccatgtccggctaatttttgtatttttagtagagacagggtttcaccatgctggccaggctggtctcgaactcctggcctcaagtcatctgcccacctctgcctcccaaagtactgggattacaggcatgagtcactgtacctggtcataaaccacattttctttctttctttctttcttttttctttttttttttttttttttttgagacggagtctcactctgccaccaggctagagtgcagtgatgcaatctcagctcactgcaacctccccctcccaggttcaagcgattctcctgcctcagcctcctgagtagcagggattacaggcgtgcaccactacacccagctaatttttgtatttttagtagagacgggtttcaccatgttggtcaggatggtctcggtctcctgacctcatgatctgcccacctcggcctcccaaagtgctggaattacaggcgtgaacaaccacgcccagccaccacattttctttatttgttcatcactaatggacacttaggttaattccatacttggctgttgtgaataccactgcaatgaacatgttagtatagatgcctcttcaacatactgatttcatctcctttgaatatatatccaatagtgagactgctgtatcctatggtggttctgtttttaattgtttgaggaacctccatactgttttctataatgggtgtactaatttacattccaccaacagtgtgcaagggttccctttctccacgtccttaggaacaatgttatagtagccattcgaacaggtgcaaggtaatatctcattgtggctttagattgcatttccctgatgattaatgatgctgagcattttttcatatacttgttggccatttgtatgtcttcttttgagaaatgtctattcagatcttttgcccattttaaaatttgggtattaacccctcatcagatatatggtttttaaatgttttctcccattccatacgttgtctcttcactccgttgattgtttcctttgctgtgcaaaagtttcttagtttcatataacactatttctctattttcactctttttgcctgtacttttggggtcatattaaaaaaattattgcccagacccaggtcatgcagcttttcctctatattttcttcttctagtaattttagtttgaggtcttgtgtttaaggcttaaatctatttggaattgatttttatttgagacagggtcttgctctgtcacccaggctggagtgcagtggtgcaatcaaggctcactgtagcctcaaagtcctgggcttaagtgatcctccctcctcagcctcttgaatagctgggtccgtaggcatgtgccaccatgcctagctaatttttttatttttagtagagatggggtacgggggtctctctatgtttcccaggctggtctcaatcttctgggcttgagcaatcctctcatctcagcctctcaaagtgctaggattaaaggtgtgagccataacacccgaccttcgatttttgtatatggtatgaggtgagagtctaatttcattctgcatgtggatatctagttgtccctacaccatttattaaaaagactgccctttacccattgtgtgttctttgcaccgttgttgaaaatcaattgactgtaaatgcataggtttattttgggtctctattctgttctattggtctatgtgtctgtacaaatgctattctatcagcaaatgttgggaagtgggagagggacagaagatttcagaacaagagtcttgaggtggggaaaaaaaacagtacattttaaggccgggtgcagtggttcatgcctgtaatcccaacacttttgggaggccgaggcaggtggatcacctgagaccaggagttcgagaccagcctaggcaacatggctaaactctgtctctacaaaaaaatacaaaaaattagccgggtatggtcgggggtcgctctgtcgcccaggctcgagtgcagtggcgcaatctcagctcactgcaacctctgcctcccggattcaagtgattcttctgcctcagcctcccgaatagctgggactacagctgtgcatcaccatgcccggctaatttttgcatttttagtagagacaggatttcaccatattggccaggctgttcttgaactcctgacctcgtgatccgcccgccttggcctcccaaagtgctgggattacaggcgtgagccaccgcatctggccagaggaattatattttaagagacaggatctctctatgttgcccaacctgatcatgaactcctgggctcaagggatcctcctgcctcagcctcctgagtaaccgggactacatgtgagagccaccgtatgcagccattggaggatattaagtagggagggctacctaattcatatttaagaagttgactttgggccatgtacggtggctcacacctgtaatcccaacattttgggaggccaggctgggcagatctcttgagcccaagagtttgagaccagcctgggtaacatggcaaaaccctgcctctactgaaaacacagaaaaattagctgggtgtggtggtgtatgcctgtggtcccagctacgcagaaggctgagatgggaggatcacctgagcctggggaggtcaaggctgcagtgagcactgatcgtgccactgtaccccagcctgggtgacaaagtgagaccctgtctcaaaaaatatatacattaattaattaaaataaaaaatcaagaaacagtttttgttgtggtttgtttgtttgttttttgagatggagtcttgctctgtcacccaggctggagtccaatggcgcaatctcggctcactgcaacctccgcctcctgggttcaagcgattctccagcctcggcctcctgagtagctgggattacaggcgcccgccaccaagcccacctaatttttgtatttttagcagaggcggggtttcaccatattggtcaggctggtctcgaactcctgacctcaggtgatctgcccgcctctgcctcccaaagtgctgggattacaggggtgatccaccgtacctggtcaactcccagtcttaacacaaacagagcatataatgatggcagacaacattccagagagggctacaagggaagtaatattcaaatgggaaggccaggtttcattcatgcagaaagtagaaggaactttctaggaatgggctggcagtatagacaactttatctcacatagattccatagtcctctcacagaggactccccattctccttaacctcagctccccagtgctgctcggcttccctccgctgccagagctcctcaacttcttgtaccccaaaccctcagcctgaagccccagcaatctccactgttctccccaagctccctctgcccatctttctcttcacaatgacttcacccctcagaattcccatacttctttataggccccacattgaaacccagccgtttatttaaaataaaacaattgggccaagcatggtggctcatgcccataatcccagcaactcaggcagcccaggcaagaggattccttgaggccaggagtttgagaccagtctgggcaacatagtgagaccccatctctatgaagaaaaaaaaaatttttttttttttgagagagactcttgctctgtcgcccaggctggagcaatctcagctcactgcaaactcttggaaaacagtctggctgttctatgaattttaaacatacagttactatatgattcagccattccattcctaggtatatatccaagagaaatgaaaatatatatccacacaaaaacttgtttgcaaatgttcatcacagcattattcataatagccgaaaagtagaagcaacccaaatatccatcaaccaaagaatagataaaaacaatatggtggccaggcacagtggctcacgcctgtaatcccagctctttgggaggccgaggtgggggggatcactcgaggtcaggagttcgagaccagcctggccaacatggcgaaaccctgtctctactaaaaataccaaaaaaattagccgggcatggtggcaggcgcctgtaatcccagctacttgggaggctgaggcaagaaaactgcttgaacccgggaggtggaggttgcaatgagccgagatcgtgccattgcactccaatccagcctgggcaacaagagcaaaactaaaaaaatgaaaaaaccacaatatgctatatccagacaatggattattacgcagcaataaaaagaaatgaaatactaatacatgctacaacatgaatgaccctcaaaaaacattaaatgaaagaaaccagtcacaagaggccacatattggattgttccatttctataaagtgtgctgccccacccactcccatggccaattttagacctcaacaccagaattgtttgaattctgaaatttttaatttatgccttctgtgttctcaccatcctattattctggttttcattcattacccctagtacgcctgttgttctaccccattgagacaccacactttttatctcttctctttatagtctattgaccctctcccctctttgcttctcccatctagttcccatctggtctattgttttaatttctctcttgccagtattaactcccttgctcaattgtcttcctatctcgtccacctagaaagacctcaaccctccaattgtctatttattccatgcctgcctccggattcttgagtactatcgaagaaaatcatgcaaatattatattggtaccactaaatatggttttcaacctttattaagttatactctgtccaccttcttcaaaaccaccatttataactacattagattgttagggctgccataaaaaagtgccactatgtgggtggcttaaagcaatggaaatgtattgtttggtagttatggaggctggaagtctgaaatcaaggtgttgacagggccacgctctatctgtaggttccaggagaggaagcttccttgccttttctagcttctggagattgccaacaatccctggcatttcttaccttgcacctgcataactccaatctctgccactgttatcacatgacattctccctgggtgtctgtctctgtgtctcttctcttcctcttcttttttttttttttttttttttgagatggagtctcattgtgacacccaggctggagtgcaatggcgcgtctccactcactgcaacctccacctcccaggttcaagtgattctcctgcctcagcctcctgagtagctgggattaaaggcacccaccaccacgcctggctaatttttatatttttagtagagacggggtttcaccatgttgataaggctggtcttgaactcctgacctcatgatccacctgccttagcctcccaaagtgctgggattacaggcatgagccaccatgcccggccaatacgtatgaattctatctgctcctcgccaatctccactgcctccttcctaggtaagactaacgtcttctctcacctggactactacaactgacttgatcagcaagttatgttgatagagcatttcaggcagaaagaatagcacaattcaagaattggcttgaagattttgaggacaaaaggaaagccaagatcagtgtgactggaagataatgagtgagggttgcagtataaaagatgaggtctgaggcagggcgaggtggctcacgcctgtaatcccagcactttgggaggccgaggcgggtggatcacgagttcaggagatcgagaccatcctggctaacacagtgaaatcccatctctactaaaaacagaaaaaattagccgggcgtggtggtgggcgcctgtattcccagctactcgggaggctgaggcgggagaatggtgtgaacccgggaggcagagcttgcagtaagcgaagatcgtgccactgcactccagcctgggcaacagagcgagactccgtctcaaaaaaaaaaaaaaaaaaaaaaaagatgaggtctgagaggcaggcagagtccagattttgggggccttgaaggtccatgataaggagtttgcattttattttattttattttaagcaaagcagtgacatgttttaaaagggctctcttagctggtttacagagaatagattgtagatcatagcatagtttacttccagcatgctctttaggcttggcaagttgagatgttaatgcgaccccaattttggggcttgctctagcttgctttcactgtatatgaaactggaaagctatccaagttgttttcattttagcttcaaataaggaaacctcttttattctctgttaactgccaaggatcaagagtccctccctggaagaggtaaggtgatacattctttccctggagaaaaaactgttagaggaagccagaaagaagaagggaaggggggcagtgtcccaatcccattagattatgcaatcaagccgaaggtacccacctccattcaaataaagtgattgtgctttcctaaaacgaaaagccattgtctatcaagaatttatgctgatttacaaatttatctatgtgaaaatctttaggaaagttaaatatttaataaatcaccttttttttttttttgagatggagtctcactctgttgcccaggctgcagtgcaatggcgcgatctcggctcaccgcaacctctgcctccggggttcaagcaactctcctgcctcagcctcctgagtagttgggattacaggtgcctgccaccacccccggctaatttttgtatttttagtagagacaaggtttcaccacgttggccagactggtcttgatcagcaagttatgttgatagtgcatcctgacctcaggtgatccacccacctcggcctcccaaagtgctgggattacaagtgtgagccaccacgcccagccaatcaccttttttttttagagataaggtctccctctgtcacccatgctgagcacagtggcatgatcacaactcattgcagcctcaaactcccggctcaagtgatcctcccgcctcagcctcccaagtagctgggaccacgggcacataccactaggcccaggtaattatttttactttttgtagagatggggtcttgctctgttgcccaggctggtctcaaattcctggacatgagcgatcctcccacctgggcttctgaaaatgctgggattataggtgtgagccaccttgcccagccataaatcatggtttgttttttatttttttgagacagagtctcactccgtcacccaagctggagtgcagtggcatgatcccggctaactgcaacctccgcctttggtgttcaagagatcctcctgcctcagcttcctgagtagctggaattacaggtgcacactaccacacctggctaatttttgtatttttagtcgagacagggtttcaccatgttggccaggctggtctcaaactcctggcctcaagtgatccacctgactcggcctcccaaagtgttgggattacaggtgtgagccactgagcctggccaaatgacctttattaaaaagacaaattttatgctgaaactgttctagaactttcagaatatatatactctatgactacaggacaatatttgccaatgggatcagttatgatgtctgtttctctttgaggaacagtctatgccctttacctatcaattaacccagcagagggctggtttctgtgtcttattggcccccacacaaagttgttttctttgccccttagtgcagtgcagacaattctattaagaaaccattctattggccgggcgcggtgtttcatgcctgtaatcccagcactttgggaggctgaggctggcggtcacttgaggtcaggagtttgagaccagcctggctgatgtggtgaaacgctgtctctactaaaaatacaaaaattagccaggtgtggtgtcatgtgcctgtaatcccagctacttgggaggctaaggcatgagaatctcttgaacctgagagaagaaggttgcaatgagccaagatcacgccactgtactccagtctgggtgacagaacaagactctgtctcaaaaaaaaaaaaaaaaaaaaaaagaaaaagaaaaagaaacctttctatgaatcttattgttgtgtttattgtaataatgtaattgaagatatttgttacgttagttttcaagaatggctgtacaatttgctgagcaatgcttgattaactcagatgcaataacctgtgtaatagcctattttcttgctttgtattgattgctagacagcttaggtattgctcacctgtagcagatatagatcaatatgatccacattttagccccattcttggcttcattttgttcccttgttttcttttcctattgattcacatttgatttatcttgtcttgcattttacatatcttactaagactttaaaatcaattcttaaacatggcaaaataggaaggggtgaatgatattgaatatactgaaaccatttccaagcaggcattaaattctatccttttttgagacagagtctcactctgccgcccgggctggagtgcagtggcacgatctcagctcactgcagcctccactttccaggctcatgcctcagccccctgagtatctgggattacaggcctgtgccaccatgcccaactaatttttgttttcttagtagacacagggttttgccatgctggccaggtggtctcaaactcctggcctgaaatgatccatccgcctcaacctcccaaagtgctggacgggtagattgcttgagcttaggagttcaagaccagcctgggcaacatggcaagaccccgtctctacaaaaaagagataaataaattgttggccgtggtggtgcacagctgtggtcctggctactcaggaggctgagatgggaggattgcttgagcccaggaggcagaggttacggtgaaccaagattgcgctactgcactccagcctgggccacagagggagaccctgtctcaaaaaaaagtaaaaatatggccaggcacgttggcttacacttgtaatcccagcactttggaaggccaaggcagacggatcacctgaggtcaggagtttgagaccagcctggccaatgtggtgaaaccccgtctctactaaaaatacaaaaaaattagccaggcgtggtggcaggcgcctgcaatcccagctacttggaaggctgaggcaggagaatagcttgaacatgggaggcagaggtttcagggagccaagacggtgccattgcactccagcctgggcaacaagaacgaaactcaatctcgaaaaaataaaagaaaaagaaaaagaaaaaataatggaaattatttgtttgcattcctgtctctataactagactataaactcttttgaaggcagttattgttcattcattcaacaaatacaatggagtcacattatgtacccatttgacttacttgacttcttagggaaaacataaaaaaaagaagaaagaccaatactctatgattccacttatgtaaggtacctggagtagtcacgttcatagagacaaaaagtagaagggtggctgccaggggctgggaggaaagggaaatgggaagctgctcaaatgggtagagggtttcagttttgcaaaataaaaaagttccagagatctgttgcacagcaatgtgaatatagttaacagtataaagtatgcgcttcaaaatggctaagatggtgaattttgttatgtgtttattaccacaattttttaaaaaaagaaaaggaagaagaatcagctagcagtgcttgagatgagaacatgaatctgtgctgtttccacggctggtcttggttccttccttcatagagtatgcatctcactgggctgaatgtgattttattgtttaaagataaatgtttctggccaggtgcggtggctcacgcctgtaatcccagcactttgggaggctgaggcaggaggatcacctgaggtcaggagttcgagaccagcctgtccaacgtggtgaaaccctgtctctgctaaaaatacgaaaattagctgggcatgatggcgggcgcctgtaatctcagctacttaggaggctgaagcaagagaattgcttgaacctgggaggcagaggttgcagtgagcaaagatcacaccactgcactccgtcctgggcaacaagagcaaaactacaactcaaaaaaaaaaaaaaaaaggataaatgtttcttacaacatggcccctacatgcaaggcagctgcttacatgggccttaatcaaagaaactgttttcctattggaggggaaaaatggtcatactaaacttgttaagagaagagagagttaaaagaatcttcaaggatcatttttactatatgagtattaccatatagtaaaatatattatatatcaaaaatatattacgtatatcatggagttcctagtaccagtttttactactgttttctttcctcaccaactctcaagcgatatgtctaatctttgaggccctggctgttgggttttctctgttctccaagtcagcacctctcagaaggcaagtggacagcctcaagtgcccaaacctaagggacttggcagctcccagctgaagccatccttcacagagtcagtggaaccaatcatcaacatgatatgattttaaggatgggaagatatgtcctctgcaccttgcaaactcatgttattcgtttgctcatatagtccctatgctgaatatgtcttccttcaaccctgctatggcttgagtattttgagtgtgtcctccaaaagttcatgtgttggaaacttaatccccaataccatagcgttgggaggtgggccctaataagaacgcgattgggtcatgagggctgagtcactgggaattgattaatgttgtcatcacagaagcaggttagttattatgagtgggtttttgtttttttgttttgttttgttttgagatggagtctcactctgtcgcccaggctggagtgcagtggcatcatcttggcttactgcaacctctgcctcccgggttcaagcgattatcttgcctcagcctcctgagtagctgggattacaggtgcgcaccaccacgcccggctaatttttgtatttttagtagagaaagggtttctactaaactccatcagggctggtcttgaactcctgtcctcgtgatccgcccgccttggcctcccaaagtgctgagattacaggcgtaagccaccgcgcccagccaagagtgggttgttataaagcgaatccagccccggatgcctttctctgtttcacatgttcgcttccaccttctgccctttgcccatgggataaagcagcacaaggccctcactggataccagcaccacactctttaacttcccagcctccagaactgtgagctaaataaatgtctgttcatcacagattaaccattctgtagcattctgttacagcaacagaaaatcgatcaagacaaactccactcaagtttcattcagtcttcaggacccagctcagtcccttatcctccgtgaagccttcttaccattttctccattgttccactcacttgtcatgtgaacatttaattaccttctttctcttatttacctgagttaaactattatgtatttctcacataattctttatttctttctttacttttttttcttttttcagacacagggtctcactctgtcacctagcctggagtgctgtggcatgaccatggctcactgcagcctcaaactcctggctcaagtgatcctcctttctcagctgcccagatagctgggactacaggcgtgtaccaccaggcccagctatttcagagacagggtctcagtgtgttgcacaggctgtattctttttttcttttttgagacagagtctcactctgtcacccagactggagtgcagtggcatgatctcagctctctgcaacctctgcctcccgggttcaagcgatcctcatgcctcagcctcccacgtagctgggactacaggtgtgcaccaccacgcctggctaatttttgtgtttttagtagatatggggttttgccatattggccaggctggtctcgaactcctgacctcatgtgatccatccgccttggcctcccaaaatgctgggattacaggagtgagccacaactcccggcccaggctgtattcttttttttttttttttttttttgagacagactctcactctgttgcccaagctggagtgcagtggtgcgatctcggctcactgcaagctccgcctcccaggttcacgccattctcttgcctcaacctcctgagtagctgggactacacacgcctgccaccatgcccggctaattttttgtatttttagtagagacagggtttcactgtgttagccaggatggtctcaatctcctgaccttgtgatccgcccgcctcagcctcccaaagtgctggaattacaggcgttagccactgcgcccggctaggctatattctttacttcttttgttattatttaatatgtcatgtttgcaggccttgactcccccattatcaataaatacaggtaaagtttataggccagacattcttcaaaggactttttatgaacattatatataaccttcccaacagctccatgatataagaactattattgtctccatttgacatatgaggaaacttgaggaaagatagctgtggtgactttgcacaagttcacacagcaagaatgaggcatagctggagtttaatttcaggctgtctgacaccatagctcaaacctatgttcaatgtgcaggattggagggatctttagtgtttatctagtcaacttccctctcttgcactgctctttctcttcctctaaaccaagctcaaatcccttttccagtttcccaagtcgttatctaaactctttttttactttttgctttctatttttatttatttattttttttaagatggagtctcactctttcacccaggctggagtgcagtggcatgatctcggctcattgcaacctccacctctttggttcagcaattctcctgcctcagcctcccaagtagctgggattacaggtgtgcgccaccccatccagctaattttttttaatttttatcagaaacggggtttcatcatgttggccaggctagtctcgaactcctggcttcaagtgatccacctgccttggcctcccaaggtgctgggattacaggtgtgagccaccacacctggcctattttttatttttttgagacagggtctccctctgtttcccagcccaggctggagtgcagtggtgtgatctcagctcactacagtctcgacctctcaggctcaagcaatcctcccaccttagtctcctgagtagctgggactacagccacacaccaccatgcccagctaatttttaaatattttttagagacagagtctccctatatttcccaggttggtctcaaactcctgttctcaaggagtcctcccacctcagcctccctaagtgctgggattacagatgtgagccaccacacccacccctaagctcttcttgccatggagaacttagtattttgccttttccatctttagacttaaaaagctctcctttaaattcatctgacttctgcctaaggaggaatatagtatagtagctcatctgtacaatggagattatagtagctatctcccaggatggttgtaaggaatgaatgaagtcaggacaaaagcatttagctcagtgcctggcaccaggagctgctgaacacacagcagcaatgagctatcctttacttctctttacagatctgtgctttggagccacacaaaccaatcacttctcttttacccatggtagtccttcagtcttttttttttttttttttttaacatggagtcttgctctgtcacccaggctggagtgcagtggtgtgatctcagctcactgcaacctccgcctcctgggttcaagctattctcctgcctcagcttccggagtagctgggactaaggtgcatgccaccacgcccggctaatttttgtatttttagtagagacgggagtgttggccaggctggactcgaacttctgacctcatgatccgcctgcctcggcctcccaaagtgctgggattacagatgtgagccactacgcccggccagtccttcagtcttgaaagctgtgatcatttgctctaagttgtcatcactctgctcttcctcttcctccttttctttttttatctctatatctctagttccttcaactgaatctcacaaggcattgtttctaggccccttattattctgtcctcctctgcccctctcactgtggtcactgaacagagtgaaaccacaatttccttgggtttgtgctacgtgtctattaatgaagcccacaattgtattagcatttaggccgccgcattatattcagctagctccagccagctccattgagttcgtagccacctacagcaccatttcttccccatctgaaactgtgaaatcatgtttttttacattctatacctgtgcagttggtttcatgaattcagatggataatttgactgttttctctcttttattttatctcctctgattcagcctatcttatcctaacatcttttggaatctttatgtcttcttccatttatgcacagattttgaggacaggattgttgcaaggtaagagaattcctgtaaagcacaagtacgtggcatgcaataagtccttgataaacattaacaatggtgattgttattattatcctcagcacagcatctggcccatagttgactctcaataaatagtcactgattaatgaatgagtgactggatccatgattggtgaaatgaatgaatgttccctctcctgaatcctaggcccagtaaatttgatattatccttcttttacagataggaaaactgaggctcagagagcttaaggaacttccccaaagtagctcagctggagagtggtaaaaccaggactagaactcaggtctgcctgattcccaggcctgtgtgactaacacttccccactatactttcttacatctgtattcaggtcagaactagttgtggagtcagaagtctgaggggtttcccgagattgtatgttccatgccctagaaaagcgggttctcctgttgtgaccctgggagatgtggaggggccatgagatgggggacagagcactggaagcctcttctcttttctcccccatgggcctctcaattttcactgccttaaactctgcttagctgtttctcgcaagaaactaacagcgctgtgtgtccccaaggagaaacttttaagaccaaggagccaagacccagggaggtgattcaacagcttgccaggactgcagtcagtggagtcaagggcccagagagcagcagcaagaatggtataaagaacactgagggcccagcgcagtggctcatacctgtaatcccagcactttgggaaaccaaggtaggaggattgcttgaggccaggagttcaagagcagcctggcgaacatgatgaaaccccatctctactaaaaatacaaaaattagcctggcatggtggcactcgtctgtagtcccagctactcaggaggctgagacaggagaatctcttgaacccaggaggcagaggttgcagtgagtgagctgacattgtgccactgcactccagcctaggcgacagagggacactctgtctcaaaaaaaaaaaaaaaaagaagaacactgagggccaggtgcggtggctcatgcctgtaatccagcactttgggaggctaaggtaggaggatcgcttgaggctaggagttcaagaccagcctggataacacagtgagacctcatctcttaaaaaaaaaaaaagtttaaaagttagccagatgtggtggcacacacctgtggtcctggtacttgggaggctaaggtgaaagctgcagtgaggtgagctatgattgttccactgaattgcagcctgggcaacaaagcaagaaagaccctgtctttaaaaaaaaaaaaaagaagaagaagaagaatgcagacctgcaggaagctgtagttatcactctgcctctttggatatcagcttccgcatctgtaaaaagtgagggtggagagttcttgccttacctgcttcactacgcaaggcatggcaatgataacagctaacacatcctgagtgccacctctgtgcctgctcctgtgttgagtgcttctcatatccttgcagttagcaccatgaaataagcatattgttaaccctctttttttttttttttttttacaaatgaggaaaccaaggttcatggaattaagttacttgcccaaggcctctaactctaagtgacagaactgaaattttgaaagtgtgcagccttcagagctgagtgaccatgggtggagagtgtttgtgaactctcaagtatgatagatgccttgtaccctttggggcaagaatgaacagtaccagtttgcagcttgttatggttgcggttggaggtgggtggctgggggagagtgttttccaaggaggcagctgaacagatcctgtggttaggatgggtgacctgatcacatccccagagtctgggtgggaaaatgcaggagggtccacagtctgaaagagagccctagggcaggttgtggtggtagaggaaactcctagcgtgtcaatccaaacagtccactgggagcccaggccttcagtaggaggggcattgtggctcagatgacatgaacctctctgactgggctaaggcagagagaagctccagttcggtcagaactttccaagaaaccagggacacgcagcccaggaaataatacctgtgggagtcagccccacctgtgacccattcatcttatctatctgcccttgggtttctggccccccagtttctacactgctctccctggatccccagcccactccttggcttccccagcacctcccttccaggcccattctcccctcacacacaccacagctctgtctgccacggcagctcctttgtttacttccagagctgccaggcccaccactagccaaacacaacgaagcccagccagtgaggggaggctccaggctcagtctgtcccctcagagagaggtaatagcctccagaccaaggaggcagctcaaaggtaggctgcccccgcactgtgcccaagcttcaggcctagagggaaagggcacaaggtctgcccatagctgggtaggaatccctactgttgaagcagctttggtgaggagccccaggaatcaaagacccagctggagggaggtaggggaaatgttgaagccccctgggtgggaagtggaggcttagactgctcctggttctccctgtgtctattctgccaggtagaactggagtcctcagcccaaggcacccatatgcctgtctccccaccagagggctatgttcccctcccaaaagtctgtgccctgtgcctccccaaagattccagctgagaaaaggaagtgagcatttactctgggccaagccccaagcaggaaacattgtcagggtgtgcctggcatttgtctgtctgaggttagtggggagtttatttatctgatgtataattatgtatttatataatgtgtaatataaaggcaggggactccgattctgtttctggagctgggggctgatgggtgagcagtgaggtgtagtgagggtgtcaagctggagggcaacagggccacagacatggtcatgtgaggaacagtggtcagtggcgagaggagatgccccaacagggagaaggagagccttggcagcccagattccccaggggagagataaaggactctttcaatggtgcccaggtaattctgtgagtatgggggtagcagggcaggcagatattggtcgatgatgtaggaatgattttagaagaaatgaaatccccaatttccctcccttttagggatctattttggagacaacaaacttgactaaggaatctcaagaagaaaatataattctgctgccaggccccaatggagcaaatagagctcgggacccaggggcctttggaaggaacaggaatgcggttagaggtgagcactggccctgcttagctgcactctctgtcccattgtgcttcagtttccaggagtgggggtggggatagggctctgaaaactgagtttatacatgaagcaacccacctccctgccctgggtcagtaattcttcaaggggtcactgggtcccctggagtaaacaagaaatttgccacagttttaggcacagttttgctttttatctcatcaatatacatttaaatctaacagtctaacagcctcacactcctcaactctatccaagccctctcctcttctctcccactcttgcccagtcagcttctcaactgtcccagggacaggaagtcaccaggcacaaatgtgatttgaggaggcagtggcacctgtggctctcctgagaggtgcttaggagagtccagaggctgagaaggcccaggtgaggagaaatggtgggctgagtctcatcggaaagcactgtttcctgggactcagtcccattcagagtctgtctccctggacctgtgcctgccactggtcacatcagcagacgggcagcaatcctcagccaggggaacttgtggataaaagggggcctttagcccaagtcacactcagagagcgagcaagcttattggaatcccctttcacccaagctgtgtagatgctcctgccacagcttcctgacccctctgtgattccaggagtgcaggaaggggctcttgggatgtgccacccaggaagacagagggccagtgctgctacctgcagccacacgactccacgaccatgtcctcatactgcttatacaccacgttgttggcagagtcaatgaagaggatgctgatgggactcagccgcgtgggcacacagcaggtgggtggtgtggactcggggtccatggagttcatcagggtctggatgactgcatgattcgtgggctccaggtgggagcgcaatgggaactcgcacagcccctcgcagtggaaagcctcgtactcaaggggtgcgatgatccagtcgtcccagcccatgtccttgaagttgacatgcagtgccttccgactgcagcgagccttaaggttcttgctgggtcgcttgccctggcgagtggccagtggggcccgccgttttcgccgctggctgaacaggtactcatacacggtcttatcgtcctggccagagcgggccttaatctcattaaagaacaggtcccgtttcttggtgcggccaaacaccaggaacagggccttctcgtggacctgccgggcggcgcggtcgaagcccaggccacggaggtccacggccctgccccgttcccaggcctccagctccaggcacagctgggccgagttcttaaagtttcggaagagcttccagatgtcgaacacctcccagccagatccgtccaggcctggcacggagcgcacatccagcaaggaggccggctgccggccgctggggcagctggacagcttcagctgggcagcccgcccgcctccgggggccgctggcttggccgtgtccgagggcttcttccgcaagatccgcagctcggcccccagcagcccatccttctccagggcactaatgtcaaacacgtacctctgcttcctgaccacgggacctcggtcatctagagagaacacccagaagtcattccctgcaacctcaccaagggagccagtcacttcgaggctgcgggggaaggccccagctctctccccgtccagagagctttctttcacctctgccccattctgacagaagccaagagccaaaccactgagagcctttttgaaaatgagagcatttcctacatagccgaccaagtaggggtgttcacctgaagatgtggctggggatgatttgcgtgattctggtgtttgtgtcatgatatacgtgttatcagagatttatcagctttgtaactgccttctacctatctctctcccagccatgagctaacgtgatgtctcatttgtgagataggtggagtgagcattaaaattactcctgttgactgggcacagtggctcacacctgcaatcccagcactttgggaggctgaggtgggtggattgcttgagctccggagttcgaaaccagcctgcacaacatggtgacactctgtctctacaaaaaatacaaaaattaaccaggcatggtggcgtgcacatgtagtcccagctactcaggaggctgaggtgggaggattgattgaccccagggaggtcaaggcttcagtgagccgtgaattcgctattgcactccggcctgggcaacagagaaagaccctggctaaaaaaaaaaaaaaaaaaaaaaaaaaaaaatacacgcttttccagaggagaatcccaaggttcagagaagttagatgacttgctcaaattctcagctgcttccaccatcccttaaaggagaccttggtgctcttgttatgcagatgaggcacagagatggggagtgacttgactaaggtcacacagcaagttaatgacaaagctggtccacactgacctacagcccaattttcctggctttccagtgcaaggattttgttgcctatgtgtcttactctcctgagcatgtgtgtgtgttacagttgtatgcatgtgtgtgattgggttcatatgtgaatatgaaagagtgtatacgttaatgacgcattatatgtataaatgattgggcttgtgtgactatttgaagagcacatatatgtctgtatatgcatgattgatcttgtgtgtgtatgtaagaaggtgtgtgtgcacatgcatatgtgtgtgattcggcatgtgtgtacgtgtgtgattcagcacgtgtgtgtgtgagtcagcatgcatgtacatgtgtgattcagcatgtgtgtataaacataaggctatgtatgtgtatgtgagaagctcagtagtatctccgaatcagcatgccctccttcctaaattgcaatttgccattggggagctttcatatattgctctagaaggtgactaattaggcctttaaactccccgtctccccctctccaagctcccttagtgctggggggcacacggacttattttatgagcccccaaggggtcacagctttccctggctgggcaggcagccagaccacctcccccacctcagccagacctgctgcctctgtgcctcccccgccccctggcagccccctccaggccagctctaatgaggagcctctcccaccctctgacccctcccccaccctgccagcctaggaccagagcaaatgagctgcaggcaacttgagcgaccaacagcccacctccctcttcacactaggaagaaactgaggccctgagagggggagggacttgcttagatcacacagcaagtggagaggaaaagctgcaacagtaacattaggtgggccgagagagacagaggggagcaggtagtctctggagttaatgaggagaatgaggcatgttcaggacagcatctaaagttttcatgttggaagggctctcagaaaccaccctgtccaaccccatataggtgtacagatgggaaaacggagaccccaagtgagaaggagctttcccaaggtcatactgcgagttaggccctgggtctgctccctccccatgtatctgaacatcattccatgactccaagatgccccatttactgtgtgcacctctcttgcctcctctatccccttgcctgagggcaaagttgcagaagcatggggacctcaagattcatttctttctctgccgtctgagaccgcctacaaacctgtggagcttggaaagttcggccagcccagcaggtacagatgcacaactgagcaatcaagtctcggaatctggtctccaactctgccacgaactggcaggtcttgtctcttctctaggctttagtgcccactctgcaccttgcaggcgttggacctggtgcttcctaggtgccctccagccctgatgtgtgggcagcctaggatctgctatgtgtgagatatgtgtcagtgtccccagacacccaccccgggccagatgcacacagtgtctcccaccagggcagtgccagggctttgaaagcccctccattcatgcagatgcccctccctctgagccgtgcccctgccaccccgccccctcaccttgccctttgtcaataaagctggtgatggtgttggccaggccagcctccaacttcacgctgctgttgcctccctttctgtcagcatcggacagcgtcctgtacagcgagagcatgtactcgtggggtgtgatggggggtgggcgaaacggctccttgggctctcgtgggggcccgggctccctggccttcttcagcaggaaggagctggggacagatcctgcttttgggggtgccttgcctccgggaagctgtccttttggggtcacagtccgggctgtagcctgccttgtttggggagggtgtcctggcttgggttcagggccgcccggtctggggggcagctttttgggttcatccttcttgggctgtgtcaggcctcctgtctgcccggtgcctccctttgccctggcattggcattggtggcccccccaccatagctgtgaccccctggcctgaagacgttccgggccagggggggcctctccttggcctctgctttggccaatcctggcctggtcccctggggtctctggcccaagtcaggggcacccaacacagtgcagatgaattccaggtccagccaagccaggtaccaaagcaagaaagtgaggagtttggggagtctcatcctctggccagccgctgaatgacaccaaagagaacagcggcagcagcaaaggtgcctctggtttggcaggaaaaaccatgaaaggagtggactttcaaaagcagcggcagcagcagtagcagcagaaggaaaggctttctcctcagtctgagactcttgaagtctgccgggtgtgtgtttgtatccagtcccatagtggaaatgctctcgtatccagacgtgcaccgtctccagtcagcagctgaaaataactcgttcttgaaaggagaaagccaaccgccccctttctcctgcacaactgactgagggcttgaaggaggcttgtataaggctgagggatttttccaagaaggaagaatggcgtaatgctgcctgtgtgctccagtttttttttccccctagttttgaatcctttccagtgaaaatacttcacacacacacacacacacacacacacacacacacacacacacactcacaggcctgcaggtgctcagaaaaatcttttacaaacctgaactcaggaattggaaacggaattccaacccaaaccaatttaattactctctgatgtcatgctgtctaaactcatttaagtgcgatatatttatgtgaaaaaaatcaccgctgccctttcgaggccatggctcacgggggctcctggcacagagccctgcagcgggactctaggcttagggggcctccccctccacggggcagactcaggggtcttcacctccacctcatggagcagcccaccccactttcccgaggagagatgctgaagaatgagctcaaagatcttaagccccagaagcatggggagtgtgggtttgtagttaagttcttagagtgtttttaaagcagtttcaactcctgcatctagtctgggacctgatttgttatgcgtgtgtgtgtgtgtgtgtgtgtgtgtgtgtgtgtgtgtgtgtgtgtgtttatgtgtgcctgtgtgtgtgtgtgcctgtgtgtgtgtgtgcctgtgtgtgtgtattgggagtagggacagcacagatggcagcatttacccacattttcttttattttaataaacttgtggtgacccagagactgaaaaatatcagtgcccactacaccccctccctacccccaaatgccattgactgagtgcatattcttcaggcttgggggcactgtcgcccttaagttcactccttggatggcggcaggtccagggtgtaccccaccaccaccccagcagagacgtcctctgagttttcttagacaagactggctgagtctggggcagcagcggcccctacaggaggctggaaaagccatttcccacatgacgctttttttttttttttttttgagacggagtctcgctctgttgagtgcagtggcatgatctcagctcactgcaatctctgcctcccaggttcacgccattcccctgcctcagcctccccagtagctgggactacaggcccctgccaccacacctggctgattttttacgtttgtagtagagatggggtttcaccatgttagccaggatggtctcgatctcctgacctcgtgatccgcccgcctcggcctcccaaagtgctgggattacaggcgtgagccaccgcgccgggcacaatttcccacatgatgtttttctggtagctctggaaggtctgaattccagctgaactcaagggtttcttaaagtgcctcattgaagtatggaagatcccttcctctggggaaccttcgccgtagagcccctgggcaacttaacacagggtcagcggggaaagctgttcgcttcacctgaaatatcctcctctctctctcccacaactggaggaagcactctacatcctgagaagtttagctgaaaatttacctccttcgggaagcctttcctcgtccccagacagagccagttaccccttctgtacatttctctacaacaacacttttcacgctgtaagaaggatggcgggggagaagcaatagtcagataggcttccttctttttttttttttttttttttttttttgagacagagtctcactctgtcacctaggctggagtgcagtggtgcgatcttggctcactgtaatctccacctcctgggttcaaacgattctcctgcctcagcctctcgagtagctgggactacaggtgcacaccaccatgcctatctattttttgtatttttagtagagacggagtttcaccatgttggccagtctggtctcgagctcctgacctcaagtgatccacccaccttggcctctcaaagtgctgggattgcaggcatctctaccaaaaatacaaaaaattagccgggtgtggaggcaaaggttgcagtgagccgagatcgcaccactgcactccagcctaggtgacagagctagagtccatcacacacacacaaaataagtaaataaataatattaataaaataaaaaaattaaaaacagacttgttcccactgaaccagtcctctctggcatccctcccttcactccctcctcaccacctctgtcactgccctgtcctcctcattgcttgcctcgctatgattctcccctataactggcttctaggcctccaggctctctctggttcaaccctctactaaaagctacccatcaaacaagtgccaacccacgtgccacctcctccatgaagccttcttgcatcctccagaaaatgcacactccccctgagctgccatcacacattttctgtgctcttttacattttttggcagctgaaagtttattcagtctctgcctctgccccctatcccaacacagtttgtttcttccactctgtattttgtcatattttaaaatcataacttaattccttataactataataatttctttacatacctgtctctcccattagattatgactagactgtgccatatttatctttgaattatacccagtgcttggcagagggcccagcccacagcagctctcagtacgtgttatatgaataaattaatctctaactggcccttattgacaaaaatcatcattttctactttgaggtgtagttatttgtggacataacctgcctttcccattagactctaagtttcttgaagggaagaattgtcttgccacttcttaagcattttgtaagctcagagagtgaataaatgaatgagttgaacaaccacaatgtctctgtacgtggcttgataaagagcaaggattctggagacaaacagacctggttttgaagcttggttctgctatttatgtattgtgtgatcttgggaagcctctaaacccctctgaaactctaaacagtgataacgatagtgcttacctcacaggactcttgttggagattcaatgaagtaaattgcggccaggcgcagtggctcacgcctgtaatcccagcactttgggaggccgaggcaggtggatcacgaggtcaggagatcaagaccatcctggctaacatggtgaaaccctgtctctactaaaaaaataaataaaattaaattgcataaagtgatcaactattaatggcaattgttaatgatagctttttttttttttttttttagatggagtctcactctgtcacccaggctggagtacagtggcatgatcttggctcactgcaacctccaccccccgggttcaagtgattctcctgcctcagcctcccaagtagctgggactacaggtgcgtgccaccacgcccggctaatttttgtatttttagtagagatggggtttcactgtggtagccaggatggtctcgatctcctgaccttgtgatctgcctgcctcggcctcccaaagtcctgggattacaggtgtaagccaccatacccggccaataatagctattttttttaaagcacttattccagtcaactagactctgggttttgtactccattgcatttatgtgttatttatcttcatgacaatgctatgaaggtagtggttttcattgttgttttttgagacagggtcttacctgttgcccaggttggagtgcaatggcgtgatcatggggctcaggtgatcctcccacctcagcctcccaagtagctaggactacaggtgcacatcacgatgcccagctaatttttgtattctttgtagagacagggtctcaccatgttgcccaggctggtctcaaatttctgggctcaagtgatctgcccgccttggcttcccaaagtgctgagattacaggtgtgaatcaccacatgtggccgaaagtaactttttttatttttttgagatggagcctcgctctctcacccagtctggagtgcagtggcgcaatctcagctcactgcaacccccgcctcctgggttcaaggggttttcctgcttcagcctcctgagtagctgggattacagatgtgtaccaccacgcccagctaatttttgtatttttagtagagatggggtttcaccatgttggccaggctggtcccaactcctgacctcaggtgatccacaaaaaagcattttgtaagctcagagagtgaataaatgaacgagttgaacaaccacaatgtctctgtatgtggcttggcctcccctagtgctgggattacaggcatcagccgccgtgcccagcccgaaggtaactcttgatacccgtcttttttttttttttttttttgagacagagtcttgctctgtcacttaggctagagtgaagagtgcagtggctcaatctcagctcattacaacctctgcctcccagtttaagtgattctcctgcctcagcctcccaagtagctgggactaccgatgcgcaccaagacgcccggctaattttttgtatttttgtggagacgggggtttcaccatgttggccaggctggtctcgaactcctgacctcaagtgatctgcccacctcggcctcccaaagtgctaggattacaggcatgagccaccatgcctggcccaatactctcattttaaagataaataaatttaggttcagaaaggttaaattattttttaaatctaattttggcttcaacacattttatacccaaaaagcctaatctggcccctagaaacactagaagtgatagggcactggggaaagttacagtattcctttcagtcaacgtctaacccagtgggctgggactttggggacatggaggagtctcgaggccagggctattgtttgaggaacagggaactcccagaaatgggctgggagcagggaaaggggactctgagcttggttagaaggccctctccagagaggagcccagggttcctgcctggctctcactataaaggtgactaatcactttggttccctctggtaattgcaaccagatgctgccgctggcagtgcttcagtcccgacatgtttaattactgggacacagcgtccctgggtcccccgtgtcccccaacctccccctctcctgtcagcaatattaatgtcaaacttgaggtagaggatgggagccttgggaagccactgacatggaagtaatctctgcagccccttctgccatgtagagccttttgcttttatgtttccccatccattgtctcattgctgttccataaaccatccttataaagtcagttggccagattattattattattattattatttttggagacagagtctagttctgttgcccaggctggagtgcaatggcatgatatcggctcactgcaacctctgcctcccaggttcgagcgattctcctgtctcagcctcccaagtagctgggactacaggcatgcgccaccacccctggctaatttttgtatttttagtagagacagggtttcaccatgctggccaggctggtctcgaactcctgacctcaaatgatccacccacctcagcctcccaaagtgctgggattacaggcgtgagccactgcgccggccggccagattattattatcccttttttattgtgtctccagatgagtaaacagtgaactgagtgataataataataatccctttttcaagcacttgtcaattttcaaaatggcttcccattcatgatgctatccgaacctcccgagatctctccgggagtcagtcctgcacagcacagcagctgagagaacaggcgctgggaccagacaatgcagtgttccagttctgccatttgccaattgggtgatgttgggtattcatttctttatctacttaactattcagcaaacatttattgggtgcctaccatgggatgggccccaggtagagttctgggtatctagccatggacaagacaaaccaagtgttttatctgaaatttctcttatgcgtttgtttgtctcttctcacattctggtggaagagacagaggaacaaacacgtaagagaatgctaagtgctgtgaagaaaaattaagcagggtcaaagaggtgtctattttagcaaggaatgccctttgagggggtgatgtttgggcagagacccagatgtagtgagaaaacgagacatactgaagtctggaggacaagcattccaggtggagggaacagcagttgcaaaggccctgaggcctttgcacttggtacatctgaggtaaggaggagctggtgtggctgaagcagagtgagcgaagggggcagtggcaggaggtgaggtcagatcatgccagaaccacatcttgtatggccttataagccctggaaagggagctggattttcttttctttttcttttgtttttttgagacaagagtcttgctctgttgcccatgctggagtgcaatggtgtgatctcagcttactgcaacttccgccttctggtttcaagcgattctcttgcctcagcctcccaagtagctgggattacaggtgcccgtcaccatgcccagctaatttttgtatttttagtagagacaggttttcaccatgttggccaggctggtctcgaactcctgacctcctgatctgcccacctaggcctcccaaagtgctgggattacaggcatgggccaccgcaccccgtctaatttttgtatttttagtagggatggggtttcaccatattggtcaggctgggctggtctcaaactcctgacttcaggtgatccacccgcctcagcctcccaaagcgctgggattacaggtgtgagccaccgtgcctggcctggattttacttttagtgcactgggaacccaatgggatgttttaagcaggagagtagtgaaataatgattaagagctaagtcactcaccttcaaatcctggttccccccatttatcagctatgtaatctcaagcaaattatttcatctctccctgcctcagtttcctcatgtataaaatgggaataataacgatatacctagctgggcaaaccggtaaaaacatacttggctcacacctataatctcagcactttgggagtctgagatgggaggattgcttgagcccagtagttcgagaccagcctgggcaacatagcaagacctgtctctataaaaataaaaaaaactggccgggtgcagtggctcacgcctgtaatcctagcactttgggaggcagaggcggggcagataacaaattcagaagttcgagaccagcctggccaacatggtgaaactctgactctactaaaaatacaaaaattagctgggcatggtggcgggcacctgtaatcctagctactcgggaggctgaggcaggaaaatcatttgaacccaggaagcggaggttgcagtgagctgagatagcaccattgcactccagtctgggcgacggggtgagactccatctcaaaaaacaaaaaaataaaaaaataggctgggcatggtggctcatgcctgtaatcccagcactttgggaggctgaggcgggcagatcacctgaggttgtgagttcgagaccagcctgaccaacatggagaaacccccatctctactaaaaatacaaaattagctgggtgtggtggtgcatgcctgtaatcccactattcgggaggctgaggcaggagaattgcttgaacccgggaggcggaggttgcagtgagctgagatcgcgccattgcactccagcgtgggcaacaagagcaaaactctgtctcaaaaaataataataaaaataaataaataaaaataaaacaataaaataaaataaataagccaggtgtggtggctcacacctgtaatcccagcacttcgggaggctgaggtgggcagattacctgaggtcaggagtttgagaccagcctggccaacatggtgaaaccccgtctctactaaaaatacaaaaaaaatagctgaatgtggtggcaggcacctgtaattccagctatttgggagtctgaggaaggagaattgcttgaacccaggaggcagaggttgcagtgagctgagatccagccattgcactccagcctgggcaacaagagcgaaactccgtctcaaaaacaacaacaaaaaaaaacttgtatcacagagtggttataagaattaatgtgtttatatatgtaaagtacctttcaatgaccaaaatacagtatgtgcttcataaattataattttatttattgctttttttttttttttttgagacagggtctcactctgtcatccaggcaggagtgcagtggtgagatctcggctcactgcagcctcgaactcctgagctcaagtgatcctcccttctcagcctcctgagtagttgggactacaggtgcaagccactgcacctggctaatcataaattacagttttgttttgttttgtttttttaaaaaagatcccactgttaatattgtccttgtttcataaatgaggaaattaagcctctgagtagttaagtgatcggcacaagttcacacagctaaagacgaccgagctagaattcaacccaagaccctaattctgaatccagtgcccttcccacgtaaagagaggactgaccaccctacaggttaggagctggcagggaggaaagcccagagtcccttcccttttcatctgtgctccttctaatctgtggggactgcctgtcccaacccctgagaatcccagcaagagcagagccgcctctgcctacactcacccgcgccgcaaacctggtttcttttcttttcttttttattattattatactttaagttctagggtacatgtgcacagcatgcaggtttgttacatatgttttttttaaatttttttattatactttaagttctagggtacatgtgcacaatgtgaaggtttgttacatatgtatacgtgtgccacgttggtatgctgcacccattaactcgtcatttacattaggtatatctcctaatgctaccccttccccctccccccacctcacaacaggccccggtgtgtgatgttccccttcctgtgtccaagtgttcttattgttcaattcccgcgtgttctcactcataggtgggaatttaacaatgaaaacctggtttcttttctaaactccgcagcagtggccactgctcaggacgcgctctcaagggctccccctgctgggatactcgggagctgcaccttgctagagttgagtgtctctgggccttctgtccataagtcaatcaaattccttccctgggctgcaaatacctgtactacaatctgaagctggaaattgtatgtgagtgttgcgtgtgtctgtctgttgtgggtagaggggtgtgaataaaataaccacatgttttacatatttattctagaaaatatttttatttttaaaataattctaaaacttataaaaagtcatacatattaggaagaaaagtaatatgaattcatgattttaaaaattcaaacagtagaaaagaatgcaaaagaaaatattttcctcccaccccagaccctgggtctttcagtcctccccagaagcaacaactctgatcagtctcctagatgactttccacacaatatagtaacatcagctttttaaaaactttattaggcagggcacggtggctcatgcctgtaatcccagcactttgggaggctgaggcgggaaaactgcctgagcccaggagttggagatcagtctgagcaacatggcacaagcccgtctctataaaataaaaaaaaaaatttaaacacctttttatcgatgcatgatattcataccaaatatatttgattataaaattaaatcatgttcattgtaaaaatattcaaataataccaaagtttataaagttaaaagagaaagttcccctctcccctcacaccccaatctctctaatcacaggaaacctctctaatcactggaaaccttgttgtcattcttgagctcagaaatctcagatccttgctggactcctccactcctccttccctccatctaattctaattcccactttgtgtataagaaccctagctggtaagtactgttatccccatattgcagctgaggaatttgaggctcagaaagggaaagagggttgctcaagaacataaggcaagctggacgcggtggtgcacatctgtagtcctggctacgggactttttgtttttttcaaaaaaaaaaaaaaatatatatatatatatatagttaagggcccccccgacttttttttttttttttttttttgtctcactctgtcacccaggctggagtgcagtggagcaatcttggctcactgtaacctcctcctcacaggttcaagcgattcttgtgcctcagccttccgagcagctgggatcacaggtgcacgacaccaggcccggctaatttgtgtatttttagtagagacagggtttcgccatgttggccaggctggtctcaaacttctggcttcaagcgatccacttgcctccacctcccaaagtgctgggattacaggcatgagccatcaggcctgaccaagggcccatttttgaggaaggagaggacctggtcctgtgggaactgtgactggacatcctttattgcccaagccctgagtgatagtgaaaagatgtcatccacttcaagaatctcaagcttgggtacgctggtcacttcgagactgacttagtgagtgagagggggctaggactggaataagaactgcctactgaggcggggtcaggaccagggagaaaatatccagctgacaaagggaatccaactagggagattgacacaattcaaccagatggtggcatcagcaagaggagtgtccggcattcctgacacatcccatgctctagcatgctgctgtgcctttgcacatgctgcttggaatccccgccaccaccccacccctgccactttgcttagcatttttttttgagatggggtcttgctatgctgcccaggctggtctcaaactcctaagctcaagaggttcttctgactcagcctcttgagtgggtgggactacagccacatgccaccatgcctggcttgtctgcttagcatttttttttttgagacagggtcttgctgtgttgcccaggttggagtgcagtggcttgaacacagctcactgcagcctcaacctcctgggctcaagcaatccttcctacctcagcctccagaatagttgggactacagtagtgcaccaccacacctggctaattttagcgtttttatccttcacaaacaagtcatagtggcctgatgctgtgtagccagctgctccctctttatagaatttactacactgtgtgtgtgtgaactatttctttacttgcttgcctgccatgtgagtttgtgaacagaggctctggacagagttcatttattattgttctttgggtccctcccagtgtataactcaacttttggcacacagtaggtgctcaatcaatattttaaaaataatgaatgaatggaacttcagcgcagcagctcaagcctataatcccagcactttgggaggctaaagtaggaacattgcttgatgccaggaattcaagaccaacctggacaacacagtgagtccccatctctacaaaaaaatttttaaacaaattagccaggactggtggcacaggcctatagtcttagctactcgggaggctgagccaggaggatcgcttgagcccaggagattgaagctgcagtgagctatgatcaaatcactgcactccaacctgagtgaaagagcaaaaccctgtctcttaaaaaaaaaaaaagagagagagagagaatgggccgggcgtcgcggctcacgcctgtaatcccagcactttgggaagccgaggtgggcggatcacttgaggtcaggaattcaagaccagcctcgctaacatggtgaaaccccatctctactgaaaaaaaaaaaaaaagctgggtgtggtggtggtgggcgcctgtaatcccagcttctcaggaggctgaggcacgaggatcacttgaacccaggaggcggaggttgcaatgagccaagatcgtgccactgcactccagcctgggctacaaagtgagactctgtaaaaaaaaaaaaaaagaatggactcagaggaacagcagcaagagactatcgttttggtgctccagactgttaccttgcagtgagaaagaaagaggaaagtggttgactttttttccctctatttttccctctctgtcatcctcagctcactttagtcactcaacatgtctccatgttaacatggagaggaagatgggggtgggaaaagtcttctttgaaccagtgtaatagctggcttagtgctttctgggcctcgcagatgtttatagccatctctatccatcatcaaagcatcatggggtgcttttatacactcttcaggggttccctactggcccctctcctgcagttcccttagcaaaggcatctattaatggccatttgtctagcttcttgttcctggggtccctttatacctccaggaagccctactgaacaggacctaatagtcagcaggcttgtctcttcttgctagagttcacaggcaggaagcatatcctggtcacgatactccctaagtgcaatggtatggattctgcatctcagattctcatggaagccccctctcctagtcacttggtttgagcggttaaaagtaatgtcctcttaatcttccccaaggaggaatggggactcatagccagaaatatctccacacaaattatctatcctccacctgcagacccctttatattgggataagggatttaggaactttcaaacagattttagactaacagaaaaaaaatatatatatatataaatatatatatatatatatatatatatatatatatatatacacaaatatatatgtagtgatttagcacctcattttgaaatttcacatacatatatatatatattttttaattcagttagtccagacggcctcttggcatgggctaggaggaatatgtataaataatgagcaaggctgggtgtaggaaagatccatattatagccctcagagagggtttgagtacaaggcatatttctagagatggaatttaggatataaaggaagaaaccgttcccctcacctggcagggaccagggttgattttctttcaactcatccattgcctttccctccaatccagcctcctttgagaactccccagtctggttcatcagacaggtctgaacatgatcagacttgaattgtctggtttaagtctttataggactcttgggccccaagccaggtgataggtaggaacacctgtttgtacgtctcaaatgctccatgcagtttgcagaatgcgttttttttctggttttttttcctttttttttttttttcgagacagggtcttactcctgtcacccaggctagagtgcagtagggccatcacggctcattgcagcctcgacctcctgggctcaagcaatcctctcacctcatttttttatttttttgtagagacaaggtctaactatgttgcccaggctggtctccaactcctgggcccaagtgatccacctgtcttggccttctaaagtgctggggttacaggcgtgagccactgcacccagccatctgcaggttgtgtaagactgatgtggtgtactcttatgcctacagaaccactagggcaggggtttctaatcccccaggccatggactactatcagtctgtgacctgttaggaccctggcagcacagtaggagttgagcagataagcgagcattaccacctgagctccacctcctgtcagttcagcagcagcattagattctcataggaggcaaatcttattgagacctgtgcatgcaagggatctaggttacacactcatgagaatctaatgcctgatgatctgaggtggaagtctcatctcaaaaccattcccacccacccctgcccatccctgtttcacacaccagctaattccactttgggctttggctcagataatatccagttgtactacattattatgttttaatacaatttccaacttgtccttactacattgtattattattcaatactagaacataatcaatgctcaataaatgtccactgggtaaatgaataaataagggaatgaatccccctttacaaacatcaaagattactatttggtttggtatatcttggtagtctgaaacctgtttactcctcatagtctttttctttgagatgaactttcgctcttgttgcccaggctagagcacaatggtgcaatctcggctcaccgcaacctccgcctcccgggttcaagtgattctcctgcctcagcctcccgagtagctgggattacaggcatgcgccaccacgcctagctaattttatatttttagtagagatggggtttctccctgttggtcaggatggtattgaactcccaacctcaggtgatctgcccacctcagcctcccaaagtgctgggattacaggcgtgagccaccgcacccggccgactcctcatagtcttaaaaaatattgtctagtttgctaatggatgttatgtcattaaactttgtaacactagggctgacttgattcattcattcaatggacacttacttgatacctaccatgtgtgtaagactgtgctaaatcccaggaataagtctcctatccacacaaagcttaaattttggagggaatgttaataggaaaacaaaataataaatggaaagtgctatgaaagaaacagaagacggccgggtgcggtggcgcatgcctgtaatgccagcattttgggaggctgaggcgggcggatcacgaggtcaggagatcaagaccatcctggctaacacggtgaaaccccgtctctactaaaaatacaaaaaaattagccgggcgtggtggcgggcacctgtggttccagctattggggaggctgaggcagaagaatggcgtgaacccggatggtggagcttgcagtgagccgagattgcgccgctgcactccagcctgggcgacaaagcaagaccccgtctcaaaaagaaaagaaacagaagactatcctagaaagtatagggtattactttagatagcatggtcagggaagacctagttgaggaagtatcatttaagctgggacctgaaggacaggaaggtaccagctaggccaagagctgggggaaaagtggtctaggtagctggcatagtgtatgcaaacgccctgaggcagaaaagagcttgatgtgcataatatttagattgtttcatttgtatttcaaatattgttgcagtgaacattcaagcacaatgcctgttgtgggattatttccctaggatggaatcccacaccactgcttctttgcatcgttttctctgtctagtgcctggagatgttccttttcccctctctagatagtttgcctttcagaatccgtgtccttccttccccttttactctccactttctctatttctcaaattagctattaagatcttttttgtgttcttacaggagaaagataaaatatagcttttaagcgttcctttctcaggttacctttggctgtggattaacctgaagccttgctgtttcactcgagctatccactcattcacccattcactcagcacttattgagcacctattttgtaccaggccttgtgctgagcgctatagtcagatgaccaaattacagtctctacgctcaagctcacaatctcatgcagcgcttcctaaaacgtgttcccaattatcagaatcaccctgggtactttctaaaatgcagattcctggactccacccccggtttagggattctctgggggtggaaaccaagagtctgcatttaccagttttgtttttaattcctactaaaaattgagaaccactgagtgcaagagtgaggcaggtaaatggagtttacaactctaagaaagtgcattaacaatttatacacaaggccgggcgcggtggctcacgcctgtaatcccagccctttgggaggccgaggcgggaggatcacgaggtcaagagagatcgagaccatcctggccaacatggtgaaatcctgtctctactaaaaatacaaaaattagccgggcgtggtggcgggcgcctgtagtcccagctactcgggaggctgaggcaggagaattacttgaacctgggaggcagaggttgcagtgagccgagatcgtgccaatgcactccagcctggcgacagagcaagactccatttcaaaaaaaaaaaaaaaaatttatacacaaaatgctacaggaataacgcatgggtcctattgggaagaaaaagttctctagaagtcaggcttaagcagaactgcagctccgggacggattaagtcaggtaaaggtaacactctgtgcagagacatgcagacaaaaccgagtgttgagtaagtaactcgcctgtaagtgttatgctgcctgaagcttctcggagcgtctgagcagcaaggtgaacaaccctcagaaaccggtcgcgctgccagtattatcgctaaccagtggcagcgagcccctttgtttctcggcagttgtaattgtagtctggtttgtaggtggagctgtgcgcaggcgcacctagaaccaggtgaccttgcacatgcgctgtatgtaacactgaagccaaaagcgaaatgattgagggcaatttttcttttctgcttccgaaatgtccctttcgcgaatccagagaccctgaccgtccccatttctggctagggatcttataattcttaaaataataccccctttccttcagggcctctctagtaagtcggctgccaatacccaacatggcgggaggccctgcgccggctcagtctgcctataggtgcaggacttggaggggcgggcccctcccaaagggcgggagtttggggggcggggcctggccctctgcctcggggtgggctccgcccccgtcccccgcagggccttagcagcggctgccgcagctcaatcgcggagcaactagccgggcgtctgcgggagccgagcgtggtgaggtggggcctcaggggcaggtgggaggtgctcgggttaaccgtccgaggcccggagacccgcccgtctagggcgcctgagggaatcccgttcgggcagcggcctcttgttacccgggaggaacccgaggcccagagaggggctgggacgcgtcgttagggcccggggcccgcttgcctcagcttcttgctgccgccagcacgctaagctccagtcggcgccgaaggagagcttcccgaccctcgtgtccagtagccgcaatcccaggctgggagggtgaggcgccgcgctctgccgcccccccgcccctcgctccctgtgtcctggcggatttgcacgtaatctatccgaaagcccagtcccacccgccacccgactctggagctcccattcttcaggaccctgctgaagtatcgcttctcagccgccttctccaggcgcagctgcattcgcttctcggtttttgcactcgctgtgcaccgagttactttcccggcccctcgttgacaccgtaagctcgttcgttagatgttatgccttgcctttttcatctctagatcccagggcctagcacgtgatgataatagtcatggcttactgtacggaatgatcacaaattgtcaggtgctactgaatgcattacacataagggcccatttatttatttatttagagacggagtttcgcgcttgttgcccaggctggagtgcaatggcgcgatctcggctcacctcaacctccgcctcccgggttcaagcgattctcctgcctcagcctcccaagtagctgggattgcaggcatgcgccaccacacccggctaattttatgtttttagtagagacggggtttctccatgttggtcaggctgatctcgaactcccgatctcaggtgatccgcccgcttcggcctcccaaagtgctgggattacaggcgtgagccaccgcgctcagccaaaggcctatttaatcttcccaacaatcctatggggtgagttctttctatagcttcacgttttacccatgaagaaactgaggtattcatagaaaaagtaatttgccaggagtcccacaactaataagtggatggagctgggaaactgtccccagggcatttgatgacttgactagattgcctttgggtttaatcaacgtctgttgaattgatctttactttggccctgggagttattggaggctaggcttgtgatcagtattttaccgcgaaggcttagaaaggagaactggtcccagatttatagaggtcacaacaaaaccaaggctactggtacgccctctgttcctttagttcttctatctttctttgctccttttcgatcagaaagctgcagacataggtgtcattatcgctcactatttaagaagtgcccctcacagagctgtgagttcgtagtccatgctttaactaatgtaatgttcatgctttaacagctaatgtaatggagagagtgtagaatttggaatcagattggggttcagtcattgctctgccactgaccaagctataagttatatgcctccccccacttttttttttttttttgagacctggtctcagtcacccaggctggagtgcagtggtgcgatctgggttcactggaacatcctgtctcccaggttcaggcgattctcccgcctcagcctcctgagtagctgggattacaggcgcccgccaccgtgcctggctaatttttgtatttctaggagagatggggttttgccatgttggccaagctggtctcgaactcctggcctcaaatgatctgcccaactcagcctcccaaagtgctgggattacagttgtgagccaccacacccagcctgtttttttgctttttatataggtaatagagctgttagcattttgcaagaccattggtgataatatggatcatgttacctaatgtcctataatagtcagtaataatgggcacttgttataaaccaggctgtgttttaggtaggagctgggaatacagcattcgataaaacaatgcttttgcacttgtggaatttgcattttggtaagtatattacataataattagatagggacagaaaaagcatggtaaggtaaataaaagtactagtgttatgtggagaggtgatagtattttatttatttatttatttgagcatcttgtcccaggctggagtgcagtggcgtgatcacagctcactgcagcctcgaactccttggctcaagcagccctcccaccttaacttcccaagtagctgggactacaggtgaatgccacacagccagcaatttttttttttttaatagagatgggaatctccctgtgttgccgaggctggtcttgaactcctggcctcaagagatcctcccaccttggtgaaactctgtctctactaaaaatacaaaaaaattagctggtcgtggtggcacatgcttgtaatcccagctactcaggaggctgagacatgagaattgcctgaaccggggaggcagaggttgcagtgagctgagatcatgccagtgcactacagcctgggtaacagagccagatcctgtctcaaaaacaaaacaaaacactggatgagattaccttggaaattaatggagatggagaagaggtctgaagccttgaggtttccaaactttagatactggggagatgagaaaaggcagcaaaggagactgagtgggagaggccagaggttggaagagagcaacagagaggccccacatgagatttaaataaggagctgcatgctaatttgtttttttcaggagtaagaaacaaattatgtctgtacacaaatgtctatactgtagtttctttctcagtaaataaaatgtttgtgtcctcaagtatttttctgtttttgctttaagtgacaaattctatttaataccattctgcatcttagtccttgtagcatttatgcctctattccaagtttaggtggtagtgttgcttctcttttaaactttatttaaatactccttttgtagtattttggatgagagaggatcaaatacataatttatctcactcttctgtcactttccactccaggttcacaggtggctgttggtctttagtaagggtgctgtcttccctgtctgatccttagcaaaagtaggaaggtaggtcttgttcatttctgtaccactgtggcagactcctgatactgagttgaaattcatgagtgtttatgggataaattaatgtacaaaagaaatgaatctttccctttttcctgcagtaatgataacattggctcagtggtttacagcttagaagtacactgacactcattatcttatttagatgtaatccaatttgttacagtttgccagctactgctcttttccctttctcaggcacattgaaatttactttccctttgggggctctgctagtttattcctagcagatctgatctggcagtgtgtttgtaaaaggatgctgaactgtgtcttgaggaagctcagaatgaaatctgaatttcagaaagattcctgagataatttttctctgtctcttctcttttattcttgttttaataaattttagttttatgaggattgttttggttttaaaaaactttaaatcattttttaaaactattttttacaacaattttagggttacagaaaaattgcatagtacagagagttcctgtataccttgcacccagtctccccttttagtatggtatatttgctataatgcaaatctttttttttttttttttttttttttgagatggagccttgctcttgtcgcccaggctggacagtgttggccaggctggtctcgaactcctgacctcaagtgatccgcctgcctcagcctcccaaagtgctgggattacaggtgtgagccactgtgcctggccatgcaaatcattttttgagataagtggggcatataaaaatataaacaaaatgaagttgctttatctctacaagcctcagtttccttatctgcaagatgaggggggtggactaaatttctaaatagctttaaaattttttaattatctgctaaagtaaaataattatataattgtaatataattttctttatttgcttaagtattactaataccaccttgccaaatcatgtttgcaagttactgacagccatatcctaaaagaaaacttaatgagaattcatggaactatgtgtggcaggactgcttattagagatattaggttgaatgatgtgaaattgccatttttgtagataaaaagtaatgagtgaggctgggcttggtggctcacacctataatgccattgctttgggaggcttggaccagggggtggctgtctgaaaccaggagttcgagacaagcttaggcaacatggcaaaaccttgtctctaccaaagaaaaaaaaaaaaagcctcggtggcacacatcttcagctcctctgaagggtgaggctggaggatcccttcagcccaggaatttgaggctgcggtgagctatgattgcaccactgtactccagcctgggtgacagagctagatcctttctctaaaaataataataataataggataatattagcaatttcatatggttcaacctaatgttttgggatagggattcaacaaagtgtgagggggcctttgagacctcataaactcccactgcatgcaaaagcccggctcagccctcaccatactaggagagaaaaggctcctcagttcccttggagtaacttggatctacattattgtaggtagagttgttggcagaaatcctgggataagagaatagtttcctggaagatctgtgcctccaaccagcagagagggattgagcttcattgaactcaacagagccaacatttcatagcaccatggtgagttggtcacacagccttggcaaaaaggctgaaaaggagggtgtaatagtatggggaaaggttgtattcccctggttcgtaggctaggaagaggcctggagtactggtgccaccaaacctttattggtgccattctattctccctactttatgcactttccttactgcctagtacaggctctgcaaactcaagtatcttcggttgttcaggaggtaatgtaaattagtaagccgagttttcctctttaatgctactataacagaaacaatagcacagttgcaatgataaatgacaactgaaatatgctatcattgtgagggagagaatcggtgtgtgcataggggaggccatgatgaactggagagcacatgccctgtctaaagggggcaggcactatacaactgtgcagagcacacgccctgtctaaaggagacaggcgctgttcaactgcacggagcgcgtgccctgtctaaacgggcaggcactattcaactgtgcagctggttgttgccttattgaaatatgggtcaagcatcactgggtattctgattttccaaaggagccagaaatatggattttatgtacattctcccaatgataaatgttggcacctaatttgaattcttaaaaactattatgtgggccacacaatggctgaaaagagctagcagggcactgatttgtcatctctggcttatggcttagctctgccaggagtgaggctcacatgcatttcttcactggacattgttgacaagttacaattaaaatgaattagacagctcctgcctttgaggtactcatggattagcagagaaaatagacaagtaatgatgataagatgtagagtagacatcagaacatatgtattctctctgtgtatatagctataaaagtgactaactcttcctgggttcatctgggaggacatgataggacgtggcatttgagccaggatgtgggaaatcaatagtttggtgcattaaagggatttggggcccttgaaatttctactgtatgtgcaaatgttaggtttgcattcgctgtatataccattttgttgataggtagttgaaaatacggatattccttagccctgctggtgagagtcttagggttaataaaatgagagaactcttcctctggcccaggttatgggataattgtgtgttttagaggcctaagtaactcagaggtcatgataccctcatttctggatgagggaagtagcacatctgaggtcacagagcccattggaggcagagcttggactaacacccagaactctttaccaccatgccttcccctgtcctgggtatctctgatgaaggtcaccgttaggctggccgcctctgcctgtggtggcccattgccctgttttggcccagctcctggtgggtgagggggtttggccatcctgctgccactggttccttctctcttttggatcctttgcctgaaatgcctgctaccccttttctttgtcagatagactacttgtgttcaaatctctctcaaccatatgccagctgtgtggcctggcacaagttttttaacctttctaagccccagtttcctcatctatatataaagagttataatagtacgtttggtgaagtgtaatgagaaggcattggaaggtttcaagatttttgtaaaaacaaaatgacgtaatgcatgtaaagcacttaaagcaacagccctccagaagcactcagcaagtgttaacaatgatgatgatgattcacacagttcacaggctcccaggctgggttaagttctcttcctttgttttctcatattatcttattatttcacatgctacattgtatgtattgtaatagtttgtgtctatttcccctgctagactaagaacaccttcagcgattcattcaacaaatgtttctgaaccactgtgccaggaactaaggatgcagtgataaaccaggagctcttggtttagtgcagagttccaaaagtcatgccaggagacactagtcctgtgagcttgtctcatggtcagttaaatttggggaatgatgctcatcatagcgcccttcagagatgagggtcccttttagtattttaaaggttctgaggagtcttgtgtgtagtaaaagaacagtcctttccatttgactatgtgctttggtccccagttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgcagctggtactggaagagcaggtgctggcactacagcagcagatggcagagaatcaggcagcctcctggcggaagctgaagaactcccaggaggcccagcagagacaagcaacccttgtgaggaagctgcaggccaaggtgaggcagctgcccttttggggaggggaaagagaacaacccccagagctaggtgctgaggtgagataagggttgcaggaggcagagtcttgtggtgggagtggcctacatctagcatggtgagataagacccagaccttctagctttcatgtacagcttctcttttgatgctcacaactgctccatgaggtacgtattatatccttttaatttaattttatttttgagatagggttttgctctgttgcccaggctagagtgcagtggtatgatcacagatcgctgcagcctcaacctcctgggctcaggcagtcctcctgcctcagcctctggagtatctgggaccacaggtgtacaccaccacttttggctaatatatctctttaaagatgaaattcacaagggttaagttaattatccaggtttcttcagctagtctagagccaaagcccatgatcttgcctctgtgatataaaaggcatatagaaagtatttatttatttatttatatatttttgagacagagtctcgctcatatagaaagtattatttaaatgcccaaataaggccaggcacggtggcccatgcctgtaatcccagaattttgggaggccgaggcaggtgtatcacctgaggtcaggagtttgagaccagcctggccaacatggcaaaaccctgtctctactaaaaatacaaaaattagctgagtgtggtggcgcatgcctgtaatcccagctactcgggaggctgagttagaagaatcacttcaatctgggaagcggaggttgcagtgagccaagattgtgccactgcactccagcctgggacacagagcgagactccatctcaaaaaagaaaaaaatgcccaaatagaaactataagatgttatggccttaccttactgtcaccacccatttcccctgttcatagcaagtttgcctaagatcctcaggggcctttgctttgggctgtttgtgccagctgtgttcattgcccagggcctgttctttttgctgcaggtgctgcagtaccgaagctggtgccaagagctggagaagcggctagaagccactggagtgagtgaggctgagctctctgcaccccctgggtcctcagtgaatatacttgttaggtttcatttgttgactgagggaggttggagtgtacaagtgaggtgtttggtggaaggctctctttctcagcctctgagaggtttatcacactgatatcttcattggacctagctggcctgtcagattccaacccttggttttcaaaggacgaaatgtaaattagattggaaggagtgtgggattagcaggaagaagtgcatgtttcctccagcaggtgtcagtgtttcttttagaaagatgcaggcctttgcgagcctacagcatgtctgcagcaaagggatgtctgtgctattagaactggctttgaaaaacccatttatttgcctttgttccagctgcctctcagtacctcctcacattttcctcagaaaagttctctcagaggaaggaaagaaccaaaacttattgagcaccctcaatgcagtccaggcagcatgaggcactgtcatatacagatggtcctccccaacttaggatggttgcaagttttcaactttatgatgatgtgaaagctatatgcattcagtatgttccttgggttatgatggggttacagctggataaacccattgtttggggttgttttgcttgcttgtttggttggtttttgtttgtttggttggttggttgttttgagacagggtcctacttactctgtcgcccaggctggagtggactggtgcagtcatgagtcactgcagcctcagcctcctgggcttaagcgatcatcccacctcagcctcccaaaaagtagctggggctacagatacatgcctcaacatctggctaattttctttattttctgtagacacagggtctctctatgttgcccaggctggtctcaaattcttagactcaagcaatcctcccactgctgggattacaagtgtgagccactgcatctggcccgaactcactgttaagttgaaaatatcataagttgaaaatgtcagccaggcgcagtggctcatgcctgtaatcccagcactttgggaggtcatggtgggtgggtcacaaggtcaggggttcaagaccaacctggccagcatggtgaaaccccatctctactaaaaatacaaaaaattagccaggcatgatggtgcgtgcctgtaatcccagctactcgggaggctgaggcaggagaatcacttgaacccaggacgcagaggttgcagtgagccgagatcatgccactgcactccagcctgggcaacagaactagactgtctcaaaaagaaaagaaaaaaagaaaacgtcgtaagttgaaaacacacctttaacttatgttcaacttatgatggatttatgggatgaaattccagcataagtcaaggagcatctataattgtgtctcttaacctgcacagcaactttctgaagggaacgatataccgctttcattttgtagctggagacactgtagctccaagaagttaagtgacttcacaggctgggtgtggtggctcatgcctgtaaccccagcactttgggaggctgaggtgggtggatcacttgaggccaggaattcaagaacagcctggccaacatggcgaaaccccatctctactaaaactacaaaaattatccaggtgtggtggcaggtgcctataatcccaactacttgggaggctaaggcaggagaatcacttgaacctgggaggcggtggttgcagtgagctgagattgtgccattgcactccagcctgggcgacagagcgagactctgtctccaaaaaaaaaaaaaaaaaaaatgaaagaagttaagtcacttcccaaggtcaaaccgttagtgtagtggaagttaaggccattagtgaaagatacatcacttcttaagttgaagattctatttactactgaaggccgtctttcaggagaggtcatcagtttacttttggagtgagggatgcagtgattgagaatagaagcatattgctaacaaaggggagaaagaataaaaagaaagtggactgccatggaagggagccttagggaactggtctgagtgatgttctctttggaggtaagtaaggcttgtctctgtctggcgcagggaccaatcccccagaggtgggaaaatgtggaggagccaaacctggatgagctgctggtccgattggaggaggagcaacagaggtgatggaccccaaactttctgacctgggtgattggccagttggtggagaaggctgatgggaaacttctgccctgagggctaatgtggacttcagccatagccctctaattcctgcaatggaaaatttcagtggttgccatcttactcccaggaggtccaagggttggactagacctttattttgcacccacttttacccctccccagtgcaggtgtgagagtctagcagaggtgaacacccagcttcgactgcacatggaaaaagctgacgtggtgaataaagcccttagggaagatgtggaaaaactgacagtggactggagccgggcccgggatgagctaatgaggaaggagagccagtggcagatggagcaggaggtaggaagaacggggactggaactgtgagaggaagcctgtgtattctggatgctgccctggtcagtactggaaggagttaacttcaggacttggatgaaaactgagctgttgctgttaaagtccctgaccatccttacctgcgcatgctggcagcctcagccttcttgggccttcagcttagacctgccactacccgcctagtctaggttctgctgggaggtagcatgacactcagagcaactctgttcctgcagcagtgacgagcttaggtttttgatggatctgaaagcttactgattcctggtctggaggtcttgcatatctagatgctaaggaggtagatatgaaactgaatgggaaagaaagagctgttatgggccctggggaattttcaggtcccagctgaaggaaacaaatgtttcctgcatttttgctttgtgctcagtggtttatgtatatcattgactcctccttagaaaagtctgtggtaatagatcccatttgttaagcagctaccgtgtatccttttctaatctggcccagaggaaggcgatataccatcctaggccctctgacctgtcgaatcccactgccaactttattaagcccttcaccataacctggatagatacccattcataaactatctcctgtaagtccctccttccttccctcagtagtcaggaggaatccaagactcttgtgttggcaaaagatagccctctgcctttgggtatgacctgggtttctgaacacacagttcttcaagggctacctgaaaggggagcacggtcgccttctcagtctatggcgggaggttgtgacattccgacgccacttcctggaaatgaagtcagctactgacaggtcagtgtggggagaagaagggaggaggtttgcccctaccaattctggactaataacagtgggctgctatagaagcgggatcagctgtgggggtggggtgggtgggggagttggtagtattggaagcagatgatttttcccagccctgctcctcaggcttcactgggcctgatcaccacactccttccctggttcctagtggagtctgctgttttccttgcttgtactcagagatctgatggagctaaaagctgagcatgtgaggctttcagggtctctgttgacctgttgtctgcgcttgactgtgggagcacagtctcgggaacccaacggatctggaagaatggatgggcgggagccggcccagctgctgctgctactagccaagacccaggagctggagaaggaagcccatgaaaggagccaggagttaatacagctgaagagtcaaggggatctggagaaggctgaacttcaggaccggtgagatggcctggggtcccaggaagggttcgctgagagagagctgactcctttagagggttagggacaggcagggggaggtgccaggaacattcctaccatggagggggagaagatgtgcccaaggaaatctactttgaaacctgatgccacagttggggcttgtactgacctctgccctcagcctgtcttttagcccagtttctttcctgttgatttatggagctagctatgactccatcctccatcaacaccaaagtgcttgccattcccagaacagccaagctcttccccctccctgtctttgtacctgctgaatttagtctggaatgcctccctcccttctctctctgccttatcctctaagacatagttcaaatattacctcttttttttttttttttttttgagacggagtctcattctatcgcccaggctggagagcagtggcatgatcttgcctactgcaacctctgcctcctgggttcaagtgactcccctgcctcagcctcccaagtacctgggactgtttacaggcacatgccaccatacccagctaatgtttgtatttttagtagagacagggtttcaccatgttggtcaggctggtctcaaactcctgacctcaagtgatccacctgcctcagcctcccaaagtgttgggattacaagcgtgagccactgcaactcgccgaaatgtcacctcttctatgaagccttctctgacctcagtagcctgctaagttactgtgcccttgtagtcttttgacctcttattacagcattgatctcactgatgatttagtttcccctaccttctttttttggtgaggctgttttactttttggattataatgaagtaggtttttaaaaaataatgacatagaagggcagggaaatgagcagagagccccattgaatctcaggacaaagttcatatatgcccatgacgagggttgtatcttcacctgttggaggtacatacataaaatgcagggctattttgttttgtttttgcttttggaggcactgagaagtacaaaagcaggccatgtcttcgtaagtttttatttctagtactttgtacttcacctgccgtatactagacactcaatacattttgtttctttgttttttgagacagagtctagctctgttgcccaggctggagtgcagtagtgtaaacacagctcaccgcagccttaacctcctgggctgaagcaattctcttgcctcagcctccaaagtagctgggattacaggcacgcaccactatgcctggctaactttttaatttttttgtagagacggggtctcactatgtttcccaggccggtctggaactcctgagctcaagcagtctttccaccttggcctcccaaagttctaggattacaggttgagccaccgtggctggccagtgaatgtttgttgagtgatgcaatacttaaacaaatgaccatacagtgtgttaaggttcttagagatggtatagaataaaattattaagacttttgctgagtgaggaggatcacttgagcccaggagtttgagaccagcctggacaacatagtgagaccttgtctctactaaaagtaaaaataaaaaaagaatagccatgtggtggcatgcacctataattctagctacttgggaagctgaggcaggaggattgcttgagagtgagctatgattgcaccactgtattccagcctgggcaacagagcaagaccctgtctcaaaaaaaaaattggaaaaaaatttaaacttttagatagcattcattcaagaaatatttatttagccactcacataatagcaagcagtaagctctaagatatagtgttaagtgtttggtgattttgctggactttgagattaatatcaagaaggttgaacataatcttccccaaattgcccttcctttttccctatcagagtcagaacctcgggctggagggaccttgggactatcccaagtgcaattctgatgttcttattggcttcagggtgcttgacttcaagatcaagcgaggcctggaagggcctgggccagggctttccttcagctcttgggcccccaaacacgtgttccagccttgagatgtggtaaatccctgcatgtgtctgagtggttttttgcttccccacttcaaggctatagcatcatgtggtattcagggagtgcagacgggctgggggtgcctaagggatttgggggaggctgcagttgggagtggttggggttggggctggggctggggtgtgctgcatcgtagctctgtccacatccatgggctgttctggtgacagtgctatgctcttctctttagggtgaccgagctctctgctctgttgacccagtctcagaagcaaaatgaagattatgaaaagatgataaaggctctgagagagacagtggagatcctggtacatgatcctttgctctggaaaggagttgggcgtgggcttgtaggttccttgtgctttatggacagatagtgcaggataccagttacatattccatgatgaaatcctctaaagctaaaaaataaattttggctgaatctgaaaattaattaactcattcatttattcattgaataaatactattgactgtctactatccctactgtattcctggggaaattgcaatggcatatgtatgcagtgtgtccttaccagagaattggcacatacattcagagacacattggcaaattagtgagttaccaggaagcggatatgtggagagatttaaaatctagtcacatgggaaacaactgaggagtatggcaatgtttagccgggagaagaaagagcttgaggccctgtgaaggcccttgaagacatgatagctgccttcacatatctgaaggactgacgctgggaaaagagagtttatgaagggccgggcgcggtggctcacgcctgtaatcccagcactatgggaagctgaggcaggcagatcacctgaggtcgggagtttgagaccggcctgaccaacatgcagaaaccccgtctctactaaaaaaataaaaaaaattagccggtcgtggtggcacatgcctataaacccagctgctcgggaggctgaggcaggagaatcacttgaacctgggaggtggaggttgtggtgagccgaggttatgccattgcactacagcctgggcaacaagagtgaaactccgtctcaaaaaagagaaaagagagtttacatatttaatgttttccagggcaaaaccaatgtcaatagctagaagttaataggggaatagattctggctcacagctagagctgttcagtagttgaacagcctgtcttgtgaaggagtaaggttttggtcattggcttaacatctgccagggatgttatcagagggcttctctaaggttggatgttagaaccctctggcttaataccatgtttcatctctataagttttcagatctctgattttaggtagctcctgaacccctattcatatgcacacccctagtcttctcatccaagctgagatcaacaggaattgtagctttctgattccctctttttttttcaggaacttgccaattcagaatatccatggggctcagataatgtaaataaatgaaatgggttcagttgtaagaattctggttttccagtgctgtttgttgtatttagttttcagtactgcaggggacacttgagctcagtattaaggaagccatgaggagcaatagggattgtgggaccctcaataataaatgtctcatctagatgaggcatctaccattcaacttcagtaaatcgtttccatgtaggaatgggggctgggtgtggcccatttgttaactttttgggagaagccagaaatttatatttttatgtaaaatctttccatttataaatgttgattcaaattttgtataagccaaataaaacatagttgcaagtctgtgtctttaggtcttcactaacacaaataggaaggaagagaggaactcttgagtcttcaagattatgtctagctttggggctagaggattctctggtttagtattaggtctcaagcatccatttactgttcagagacagcacccatcccctatctaataatagtttacatttattgaacatttgctttgttccagacactatattgaataatttacatgcatttttcatttaagcctcaaaacaactagttgctgtaattatttctattttaaagaaaaagaagtaagtgatagaagctagtaagtgatagagcaggaattctaatctgtgaagtccaatttggaactcataatcacttaatctaaacttgtaatcaccacatcacattgtcttcagactcttcagacaacattagcattgacatatggtcagggaaaaagtggggctgatagaatagacagaatgagactttggttgtttggggtcctggaataataaattcacttttgagagtttggctctgaggctctgttctattccctgttcaggagacaaatcacacagaattaatggaacatgaagcatctcttagtaggaatgcgcaagaggagaagttgtctttacagcaggtgatcaaggatataacccaggtactgggaagcctcctgttcatggtaaccaggttatgcctccactccccaggtctccatgtcctttcagtcctgcctagatttccagtctctgaggttcgggtgcttaaagtcttgtggggatgagttttgtgtgtttgaagaccagaaccctaagagatagctaagcattcacgtttagcactacctgatgggacaggccctctttcctgtttctagctgcagttctcaggctggaggctagattctggtattcaatatctcaatcgtttcttctttcatttcctcatttattgttacctcagacagtgttctagccttgttgttagtcctagacttgggtgaccaaaggtggagagttgaaggaaccagacttttatgctcagatactcccctccttcccccaggggagaggacctgagaaggaaaacatcaggtttgtccaggctatagggttaagtccctctatagactctaggctttggtcagtagggtggtgaccttgctgtattgggtttcaggtcatggtggaagaaggggacaatatagcccaaggctctggtcatgagaactctttggaattggactctagtatcttctcccagtttgattaccaggatgcagacaaggctcttactctggtgcgttcagtgctgactcggagacgccaggctgtgcaggtaggaaccctcagcattccacctcagtcacaggggtttgtgtctaaactggtttgtgcctcaggtacctccctagcctggactatccctttcacttttttgaccagtcatgaggtgttctgtcaatatcccagagtaaatctgcctatgtctgctgaattgtgcttgtgagtagcaggcacatcctccacgccaatggcatgcttcactttgtgtacaatctttgcataacagtatgcaaagattgggaaccagagccctgggagattattgggtcaacgttctccaactctgagagtcttaggcacacttaccactcccccatgccactgtacatttggagatgacgaactctaagaatctagagccacagaagcccaatgacctctgatggcctgtcttcttgaatagttgcatctcccttctcagctttcttttgttgcaccagcccccgacccccttctccagccccactttcggggttctgacatccctcctttgcccttgttcatcatctggtttctcttgctctctctccacaggacctaaggcagcagcttgcaggctgtcaagaggctgtgaacttgttgcaacagcagcatgatcagtgggaggaagagggcaaagccttgagacagcggctgcagaagctcactggggagcgggacactctggcagggcagactgtggacctccagggagaggtggactctctcagcaagtgagcagacgggctgttcatcccaccctcccagcctggtctcagtctcagtcaccatccagccatttacccactcccatcaggtttttggggtgctgatcctgttctccttgagactcagggctgttttgcccagtgtttcacttgtttctccagaacaagcttttggggttggagtctttgtgatgataaaaaagttttgcactagaaacagaagatgggatgttgaaacagggtctcttggccctgtgatgcctgcttccagaaagaattttaggtcctatggtctctgctcatctctgattcccttcttccagggagcgagagctgctgcagaaggccagggaagagctgcggcagcagctggaggtgctagagcaggaggcatggcgcctgcgaagggtaaatgtggagcttcagctgcagggggactctgcccagggccagaaggaggaacagcaggaggagctgcacctggctgtccgggagagggagcgtctgtaagtgagactagtctcctcctcgctgggccctggtctttcttcaattctacaccctccccgtctactcccctctgttacaaagtagagtatgtagaagtctggcatgcagtgggttcagattagcttgctgcttcttcctttgcagaaagatgaatatggaaagttcgtggttggttaagtcttagttgagcacccatatgggatgagacactgagggggatacagaaatgaataagacaaaagccctgatttcagggaacttgccagaagacagacaactcactgtgacatgaggctggatgaagtatgagttaaatagagtttcagaccaagtcctttgggagcacaggagtgacagctaattattgaagactaggaaatgctttatggaggagagagtagactttgagctgggcctttacctatttggttagcagagagtgggagaagagctcaaggaacagattagcaaagaaaaggcggcaggaaggttcatggcatgttcagagtaggctgggctggctaaagggtaagacttatacagggaagtagtgggaaatgtgctagctggtcaagaaagggaaatccagaatcaatggccccagctaatctgtaaattcccctatatgatgtcacagaaaaagcaaggactttgagctaggcagaagcttagtttaaattatggctctgtcacatggacagattatttgtagaatgatgataatatttaccttgaagggttgctgggaagatgagagcaacgttttggaaaacgccagcatagaacctggcatatggtaggtctttaataactgggagcagggatataccttcatctttgctgtatttccctcctctcctgtgccccagttccttgtacctggtaggcatgaatagtggaagcttgaagggctgccataagggtcatgacttgtgctaagaatgatctccctgtaccaaggagaagggcagacaacccctaacaacaaaaaattagctgtagctgaatgtggtggcatgtgcctgtagccatggcaaggtgagatgggaggatcacatgagcccccaggagtttgaggcttcagtgagctaagaagatacacagagaagtctcactctcatttgtgctttctccatcccatttcccttccccctttaggcaaccattttagctgacttcttgtttatcttgccagtgctccttcatgcaaatacgggcatatattctttcttcccccactttcttgcataaaaggtagtgtatcatgtatatactgttctgcaccttgatttttttcacttgacatgtcttagaaatctttccttatcagtgtttatagaccatcctcattctgttgcatagcaaaggtgattatattcctgttacctttggggttatggcccatccctaagagttcctctagacccctctctttcccatcttagtcaggagatgctgatgggcctggaagccaaacagtcagaatcactcagtgaactgatcactcttcgggaagccctggagtcaagtcacctggaaggggagttactgaggcaagagcaaacggaagtgaccgcagcgctggctagggtgcgtggcctcctctcctcacttgctgggtgggcggcttcgaaagtgtgttcccatgcagcctgcctcattcttcaccttcaagccaggatccctcatctttcctcaatcattagtctgcttctgggttctctattccaacataccctctatattggaattagaatgggctttctaaagtatatacctggttatgtcagtctcttaaaaccattcaacggctttctagctctgtggtgccacattcaaagctttttgtcatgtgcctcaaagtgtgttttagcctccccttctactgcaaaacccatcctaacacctcatatcctttgctcctgccacagcagtaattgccttctcagttattccatgttcttcatgactctaatactctgcatgtacttttccctttctctgcactacttctttcctcttcctttatgtgcaaactgttcctcatctctcagtacacaacttaatcgtcaactcctctaccaagcatatttgactcttccaaactatattaatattttttttagttcccagagcactttgtgcttacattttctgtggcatcattacaatcatagtcatttctctatcctaactttggtatctctatactgtgaggtcctgtctcactccttaatgaatgaatgaagggaaaacttgtttagaatgcaggagagggaatggagtattaactgatctctgtaccaaaaagcagcagtgttgggaatgtgaactgtttactgttccaggaaaattggaaatatgaaactctttaatcctttttgttttttaggcagagcagtcaattgcagagctgtcgagttctgaaaacaccctgaagacagaagtagctgatcttcgggctgcagctgtcaagctcagtgccttaaatgaggctttggcgttagataaagttgggctgaaccagcagcttctccaggtgagcaaagattttcctggtccccacagaagggctgggccctaactgagagcaagacggatcagctcccaaatgtaggtctgaaatgagcaaaaggaacatttacaatgcagaggagagcaaagactgtaaggattgggcttagccattataaatattcccctcccacacctccagcagaaccacctctggacttcagggtaagacaccaaggttgggaaggggcccatgtcctctggaaggaagactaggttttttgctggggttttcttgagatggatctccctctgtcacctaggctggagtgcagtggtgcgatcttagctaactgcagttttcatctcctgggttcaagcaattctcctgcctcagcctcctgagtagctgggattacaggcatgtgtcaccacacctggctaattttttttttttgagatggagttttgctcttgttgcccaggctggagtacagtggcacgatcttggctcgctgcaacctctgcatcccgggttcaagcaattctcttgcctcagcctcctgaatatctgggattacaggcatgcaccaccatgcctggctaattttgtatttttaatagagacagggttttacgatgttggtcaggctgttctcaaactcctgacctcaggtgatccacctgcctcagcctcccaaagtgctaggattacaggcgtgagccaccacacttggctgccctgggctagtttttgtatttttagtagagatggggtttcaccatgttggccaggctgatcttgaactcctggcctcaggtgatccatccacctcagcctcctgaagtcctgggattacaggcatgagccaccatacccggcctaagtctaggttgttaatcctgttgggtgagataatagcaatcaccagaaaagaatctgctgaagagcctaagtcccaaagaatcttttctataggttataaatttaacctataattatagcgagggaacctccttgcaatctctgtttccttgagtgttctctattccattattctgaattatttgagagcaggactttgccttgcatatctccgtccccagcatccagcccatctagtacctggaatataggcactagatcaaatgaatggattttcccccatcttataaacactcctttgttcatctttggagaatagattcatatctcacttggatttcagtcttagcatttgattcctaaactaaccatttgtctttgatgcttgtactcccttccctttttggccagtagttagaggaggagaaccagtctgtgtgcagcagaatggaggccgcagagcaggcgagaaatgctttgcaggtcgacctggcggaggcagagaagaggagggaagccctgtgggaaaagaacactcacctggaggctcagctgcagaaagctgaggaggctggggctgagctgcaggcagatctcagggacatccaagaagagaaggaagaaattcaaaagaaactaagtgaggtgagaagccaaaatggacaccatcatgtctaggtgtaatatatgctcattataaaaaattaaaacactacagaaattatctggaaagtgaaaaagtcttacttcctagaaatgaccagtgttactagtttgcagtatatcttccaattttaaaaaagaatgcctataacaattcttcactgaggctgggcgcagtggctcatgcctgtaatcccagcactttaggaggccgaggcgggcggatcacgaggtcagaggttcgagaccagcctgaccaacatagtgaaaccctgtctctactaaaaatacaaaaattagcccggcatggtggcacatgcctgtaatcccaactactcgggaggctgaggcaggagaatctcttgaatctgggaggcggaggttgcagtgagccgagattgtgccactgcactccaacctggatgacagagcgacactgctcaaaaaaacaaaaagaattcttcactgattctccactacttcattcacaccacccagtttgaattagaagcttctccttatactctgatagcacctcatgcttattttaactaccacattcctcatgctataattatctgtttatatgtctctaccattagaccaaaagctccttgaaggcaaagctatatcttatttgtttttatttctccagcttttagcatagtgcctaccacataacaggggccaagtaaatttttttcctgagccaatgaatgacctggctcaaaggtcatctttctcctctacaaaacctctcattgtcctaataattgtacggactctcccttcacagagtccctttctcgggacattgatgactttcttcccagtattatgtgtgcatcttctcaaggccaaaacctccttaggggcaggtcttctgctgtccctagcacagggtcttgctcacaggggagcattcttcctgggctgggggctctgtgggcggatcagggaaatagataaatgccacgtgctattgggtaagcaatccgggctcacagagctgggtccagaatctctgaagaggcaatgaccctaacctggtggtagcggccccaggggaatccagcctctgctccatctctcaccacattcttcccctcagtcacgtcaccagcaggaggcagccacgactcagctggagcagctacatcaggaggcaaagcgacaggaagaagtgcttgccagggcagtccaggagaaggaggccctagtacgagagaaagcggctctagaggtgcggctgcaggccgtggagcgtgaccggcaggacctcgctgaacaactacaggggctcaggtagggcccagactcagttcagccaagcacagagagagctttgcaaggcaaaggcgtgaagctaagctccctgccataagtatgcaggtcctaaattgattatgaatttataattgcccccctaacttctccaggtagccaatacttagaacccagctcctcttgaggaagggtaaggggcttgatgggtaagaaactcttctgattcctgaacctcacagctcagccaaggagctactggagagcagtctgtttgaagcccaacaacaaaattctgtgatagaggtcaccaaggggcagctggaggtccagattcaaactgtcactcaagccaaggaagtaatccaaggtgagaacccaactgggatgggatgcactccattccatggagatgttgaaaggcaggaagatggtgggagactattagaggtccttctccagcagggtgcagggcctctgagatgggagttgctcatgaggtcaggggagagggagaattttattaggtaaaaggagggggcggaggcctgatcctgtccctggcatgttaggggaagtgaggtgcctgaagctggaactggacactgaacggagtcaggcagagcaggagcgggatgctgcagccagacagctggcccaggctgagcaagaagggaagactgccttggagcagcagaaggcagcccatgagaaagaggtgaaccagctccgggagaaatgggtaagtggtcaatgtggccgggtatggcctcccttccatgagtgctctacctgctgcctcttggtccagttattgctgctcgtatgagtgaaattttgtaaccaagctgtaaaatccaacttcctgctattaaatgagttaatatatgaaaagcactaagagtagttcctagcatgtggtgggctccctatatgtgttagccattattattgttgttgtgttggtgtgtacagagaattgagagtggaccctgggatttaggattattaaactggcctcaggatgaaaacgggggagaggaatatcttggatgcattcttgtgcagttcagaactgtgttttgtcttttaataatgtaatttagtccatttggttttattgtggttttaggtgtatttggatttatttgtgccatcttatgttatttgtcttgcttttttatatcttttttttttttttttttccttgagacagtctcactctgtccctcaggctggagtacagtggtgcattcttggctcactgcaacctccgcctcctgggttcaagcgattctcctgcctcagtctcctaagtagctgggattacaggtgtgtgccaccacatctggctaatttttgtatttttagtagagatggggtttcaccatgttggccaggctggtctcaaactgacctcgtgatccacctgcctcagcctcctaaagtgcagggtacagctgtgagccactgtgcctggccatttttatatcttttagggaggggaaatctcctttcttaacttcttttagaggattaagttgggtgattaagttgtattcttttctcacctcttttttctctctgcaactgtggatgatatatactttattttaaaaatcctgttagtggttacctttaatatttttaaacatatacttaataaaatctcaaggttcagtagttttacccttttcctgaacgatacaagggtcttagaacattttacctgggccagggacagtggctcatgcctgtcatctcagcactttgggaggctgaggtgggcagattgcttgagcccaggagtttgagaccagcctggacaacacggcgaaaccccattccctacaaaaaaaaatacaaaaattagccaggcatggtggtacacactgtagtcccagctacttgggaggctgaggtgggaggatcacttgagcctaggaggttgaggctgtggtgagctgagcaccactgcactccagcctgagtgacagagtgagaccctgtctcaaaagcaaaaaagaacattttacttgtttcactgctccctaatttataggctattttgttcagtgtgttcagttctaactagtttaacaccacaaattatgatttttttattgttttatacagtcaatatttgttcagatacaacgaattgataccttttctgttcaccataccttcttgcatgtcagactttctattcagattttttttttttttttttgcctgaagtaggattttctttggtaagggtctgttggtagttaattgtctgaagatgtttctattttatttttattcttttattgaggcagggtctcactctgtcgcctagactggagtgcagtcatgtgatcatggcctactgcagccttggcctcctgggctcaggtgatcctcccacctcagcctcccaagtagctgggattataggcatatgccatcacacccagctaattttatttttggtagagacggggtttcaccatgttgcccaggctggtctcaaactcctgggctcaagcgatccacccgcccttggcctcccaaagtgttgggattacagaggtgagccaccatgtccagcctacttttattcttgaaagatagtttctggctttgttcaggcttaaaaaatagatagatagatagatagatagatagatagatagatagatagatagatagatagattcactaagtaaaacattcagatataagtttctaggatgacaattattttctctcaacattgttggtattgagaagttagctttcattttaatcattccacagtttcttgtgtttattattatttttttgtttgtttgttttttgagacggagtctcgctctgttgcccaggctggagtgcagtggcgcaatcttggctcactgcaaggtccgcctctgggttcacgccattctcctgcctcagcctcccaagtagctgagaccacaggcgctcaccaccatgcccggctaattttttgtatttttagtaaatacaaaaattttttgtattcaccgtgttagccaggatggtctcgatctcctgacctcatgatccacccgcctcggcctcccaaagtgctgggattacaggcgtgagccaccgtgcccggctatttatttttttatatatttttttattttttatttttttgagacagagtcttgctctgtcacccaggcttgagtgcagtggtgcaatctcggctcactgtaacttccacctcttgagttcatgcagttcttctgcctcagcctctagagtagctgggattacaggcacgtaccaccatgcccagctaatttttttgtatttttagtagagatggggtttcaccatgttgcccaggctggtctcaaactcctgggctcaagtgatccacccacctcggcctcccaaagggctgggattaaaggcgtgagaccacgcctggcaatttcttgtgtttagatgtgtatttcttttatttggttggaatttcttagacatcctgaatttaagatttcatgttgaaatatcaattctggaaaattcttatatattatctcttcaatattacctctttcctactgtcctgcttttatttatttactctttaaaataaatttttttttggccaattgcagtggctcatgcctgtaatctcagtaatttgggaggctgaggtgggcggatcacctgaggtcaggagttcgagaccagcctgaccaacatggagaaaccccgtctctactaaatatacaaaattagccgagtgtggtagcacatgtctgtaatcctagctattagggaggctgaggcaggagaatcgcttgaacctgggaggtggaggttgcgatgagctgagatcgcgccattacactccagcctgggcaacaagaacgaaactccgtctcaaaaaaaaaaaaaattttttttttttaaatttattttattttattttttagagacagggtcttgctctgttacccaggctggagtataatgatacaatcatagctcactgcagcctcaaactcctgagctcaagtgagtcctcctgccgcagcctccgacgaactgcaactacaggcacatgccaccatgcccagctaattttttaattttaattttaattttttttttttttagagatgggtcttgctatgttatccaggctggtctcgaactcctgggctcaagctgtcctcttgcctcagcctcccacataagctgggactacaggtgcacgccaccatacctggctcttttcctactttcttctctctttctgtactctggttagttgtatgtcagacctttttactctatccttcatgtatcttcactgcctcttgcattttacatgtttacttttctctttgtatgctgtgttctggattatttttttcagatctctcatctagttactgattttccttttcagctgtgtcgaatctgatgtttattctattcaccaagttttaaatttcactttttaaattttttatttctagatattttatttggttattttttcatatcttcttggtcatttttttcagtctgttttccctaatttgtattttcagtccattcttttaaacatatgaaacatacttgtgtcctgtctagtaattccaataacttttaattaacgttttggggtctagttctgtaatttgttgtttctgttggctcttactcatgggcttgtttccctgtgtttttgtgattcttgtctatgagcatgtctttggaaattttcctttttttttcttttttctttttttcttttttcccccagagacctttgttctgaggaaggttttctgtgggaatctttttaggcctgaggcaaaggagtttttcctcagaggatttgtgcttctgtcaggaagctggaggactagcatcccaggaccaccttaaagtaaattttctgtttaaagttttttgacccacagtcaggcccagaccccatgtgcagctcagcttgtggttatgaattttcagaggagacttttttcctaccctgtatcaaagttgagataagcatatttccttgataatttccttctatagagtttattttgttttgtcccctctccacatccctccagtttctctttttctcccttcctccccatgtcctccttctttttgccttttcccccttaagctgaggtcactacagcccagagataggcatttttttttttctttctagagatggactatcactatgttgctcagtctgatcttgaactcctgggctcaagggatcctcctgtctcagcctcctgagtagctgggaccacaggcacagtccaccatgtctggctttttgttaaggactatatgctaggctttgcagaccatatggtctctgttacaattatctaactttgcaattgtagtgcaaagcagccatatataaacaaatgagcatgactgtgctcagataaaactttatgtatagatactgaaatgagaatttcatataattttcgcatgtcacaaaacattattgttttctaccattaaaaatgtaaaggctgggtgcagtggctcatgcctataatcccaccactttgggaggctgaggcaggacgattggttgagaccaacctgggcaacatagcaagaccctatctctttaaaaaaaaaaaaaaaaaaaggtaaaggctgggcgcagtggcttacgcctgtaatcccagcactttgggaggcctaggtggccggatcacctgaagtcaggagttcaagaccagtctggccaacatggtgaaactccatctctactaagaatacaaaaatattagccgggtgtggtggcacatgcctgtagtcccagctacttgggaggctgaacaggagaatcgcttgaacctgagaggtggaggttgcagtgagccaagatcgcaccattgcactccagcctgggcgacagagtgagactctgtctcaaaaaaaaaaaaaaaaagtaaaaaccactcttagctcatagccagagagcaacaggtggtgagccagatttggtccacatactataatttgttaaccccagtccagatttttgtttgtttgcttgttttgtttagagataaggtcttgctctggtcacccaggctagagtatagtggcacagtcatagctcactgcagcctcaaactcccaggctcaagtgatcttcctgcctcagcctcctaagtagctaggactacagcgtctgcctggctttttttttttttttttttttttttttttttttgagacagggtcttgctctgtcactcaggctacagtgcaatggtacaatcatggctcactgcagcctctacctcacgggctcaagtgatcctctccagcctcctgagtagctgggaccacaggcatgaaccaccatgcctggctaagttttttttttttttttttttatagagatggggtttcgtcatgttacccaggctggtcttgaactcctgggctcaggtaatctgcccaccttggcctcccaaagtgctggggattacaggcgtgagccaccacgcccagccacctggcttatttttatttttattttaaattctgaattacatttgcattgggtgaaagatagtggatttacttttttttttttttttttgagacacagtcttgctctgttgcacaggcagtggtgctgtttcagctccgcctcctgggttcaagcaattctcgtgcttcagcctcccaagtagctgggattacaggcgcatgctaccacacctggctaatttttgcatttttagtagacactgggtttcaccacatcagccaggctggtctcgaactcctgacctcaagacaaggtcttgctattgcccaggctggagtgcagttgtacaactgcactgtacaactctagctcactgaagcttcaagctcctgggcttaagcaatccttctgcctcagcctccagactagctaggactacaggcatgcaccatcatgcctggctaattttttttttttttggtagagatgtgatctcactttgttgcctaggctggtcttgaactcctagcttcaagcaatcctcctgccacagcctcccaaactgctgggattataggtatgaactaccacacctggcctacaccacaagtcttgctttgcttttggcttctgtggaatttttattattttcctgctggttctgtgatacattaaaatacatatttaatattttatccagcattttttgcgatttcgtagctggagggttcagagatcttgtttatcaagtatctggaaatggaagttgacttgtgctttatgtgtatttgtaatttgattgttattatgaggcaggcttattggcaagatgataaccagaagtttgcttatttttggaattctgtgcctagtctatagtcggtgcttaaaagtatttgttgaatgaacactgattctagcaggaatcagatgtataccatgtactgaaaactccataaataaaagatgctataaaacttctgaatgataagccagctacctacgtggccttggtttccctaaaaggattgactatagtggccatatctgggtcatgaaagagccttttctctcttttccttttctgtcattcagctaatcctcctgacttctgattgtcccactttattatttctctatgattgagcaggtcaactgccctcttaaaactctcgacagcctgttcgttttagcagtgactgccttctcctggaatcctggcaattagaagcactcttgggaggccgcgcgtggtggctcacacctgtaatcccagcactttgggaggccgaggtgggcggattgcccaaggtcaggagtttgagaccagtctggccaacctggtgacaccccgtctctactaaaaatacaaaaaaattagccaggcgtggtggcatgcacctgtaatcccagctacttgggaggttgaggcaggggaattgcttgaaccagggaggtggaggttgcagtgagccaagatcgcaccactgcactccagcctgggcaacagagtgagactctgtctcaaagaaaaaaaagaaaaagaaacactcttggcagttgtattctttattcttccatctactgtctgtctcccctttaagagtaatgatattggacacttgttaagcacctccccatgccaagcaccatgctgaatgctttattcacacaataaaggtgaataaatgcatggagaagtcactcagggctgggcgtggtggctcacacctgtaattccaacaatttgggaggccaaggcgaaaggatcgctagaggccaggagttcgagaccagcctgggcaacatagcaagatccccatctctaaataaataaaatataaaaagagaagtcagggttacatggctaataaggggtagaaaagggattcagggcccaaactcctaaccatttcttttttatccacctctgtaatgtcccttccaaatggttgcttagctgctattgtattccatcacttggctgcccatttattttagatagatctagttattaggaaattcatgttgaaccaaaacctattaccaggaacaaatgagccttagatttgcttgaaataccccaccaacatggttgctttcttctaggcatgttacaatttactcatgtcccagtggtgtaaaggtggcactttgaactgggcagaatattctgttcatggtcataccagcaatgctggactgttacttcctacacatcacagaattagctcttcttgtagctataacacacttctaactcacatagagcaaatagatcagtttttttaacacttgcaactgctattaacattcatctttttcatatttttacagttggctttggctttttgcagtcacatactctgccactgagctatacccgctgtctttggctttttgaaccagagggtaaaatgatttgtcattcatgactgtcctgtaactgacattacacattgccgggttttataaggaagaacaaaggaagacctcttttttttctttttattattattatttcttttgagacagggtcttgctctgttgcccaggctggagtgcagtggcgtgatcagggcttaacggcagcctcaccctcaaggccctcctgggctcaagtgatcctcctacctcagcctcccaagtagctgggaccacaggagtgaaccaccacacctgactaatttttgcattttttgtagataaggggtttcaccatgttgcctaggctggtctcaaactcttgggctcaagtgatcatcctacctcggcctcgcaaaatgttgggataatatatgtgaactaccacgtccagccagaccactgtcaattgtatggtctgggaaggcttcaccaaggaagtgttagtttaggcgtgaggaatgatggagtaggggggagaagggctttccaggtagaaggaagcatgagtaaaggctctaaggcatgaacatgttggctgggtgcagtggctcacacctgtaatcctagcactttgggaggcctaagcgggcagatcacttgaggttaggagttcaaaaccagcctggccaacgtggtgaaaccatgtctctactaaaaatacaaaaaaaatagctgggagtggtggcgggcgcctgtaatcccagctacttgggaggctgaggcgggagaatcacttgaacttgggaggcagaggttgcagtgagccgagatcaccccactgcactccagcctgggcgatagagtgagactctgtctcaaaaaaaaaaaaaaagtgcttagtgtgctcaaggacctgcaaggaggcaagtgtgtgtagccagggtgtagtgaatgagggggaaagctgcacaggatgacactgggaaggctgaaacactagaggcgttcccattacatgaataagcaacgacaaacttacaagcattttaaaggaaaagtgcagggaatactaatgtgatgatgatgctggctgttgtgtattgcccgctttctgtgtgctacgcacatttaaagtgattcacatgacttatctccatcctcaatacaacctgaggagaatgacactgttgttatccccattttaatagatgaagaaactgaggcacagagttgtttagaaattgagatcatgctagtagtggtagattaaagattctccacccaggcagcccaactccagagcccttcacctctatcctgtacacctaatagagggtcctgaactagtcagagagcttgggaaagctttggttgctggaagaccgctaagacaagcagcacccctatcctaatgctcttatataatacagggagacatcctcactgggccaggcctgattcttcaggggctaactctgcaactctgagtagaggagagcaggcagcagacagccagaattggccgcctcagttcattgttacaactgtcaaccacaatgtggctgctttaaagataacaaatacggagctgtgtgtggtgtcatgcccctgtgttcttagctactcaggaggctgaggcaggaggaccacttgcgcccaggagttcgagtccagcctgggcaacatagtgagaccccatctctaaaaataagaatgcctaggctaggcacagtggctcatgcctataatcccagcactttgggaggccgaggcaggcagatcacttgaggtcaggagttcatgaccagcctggccaacatgttgaaaccccatctctactaaaaatacaaaaattagctgggcatggtggggggcacctgtagtcccagctgctagggaggctgagacaggagaatcacttgaacctgaaaggtggaggttgcagtgagcggagatcgtgccactgcagtccagcctgggtgacagggcaagactccgtctccaaaaaaaaattaaaaatagaaatacattttaaaacccagatacttgtagcatatataagggacaattgcagtttggaaggtacttccacatgtattatataattttattttttaaaatgaatctcatttggttgtcatgaaatttggtaagatagataaggcagggaatattagccttgctttacagatgaggcaacaggcttagagaggtaccaaggtcaccccactagtgagtagtagagagactttgtttttccaatccagtacccctgcctcccctcctcacccatttggttctaatggtgtttccttcatgtggccaggagaaggagcgctcctggcaccagcaggagctggcaaaggctctggagagcttagaaagggaaaaaatggagctggaaatgaggctaaaggagcagcagacagaaatggaggccatccaggcccagagggaagaagaacggacccaggcagagagtgccctatgccaggtgggaagctaggaggattggagctgcacgtccagtcagcgatctccttaccttgaccacttccttttctactcccaagaggagtgctgcagaggggcttccagaagagagggtagctacccactttgctaacagtgagcagggtggtccgcaccattagccacagttccggcagtatgtcatacttcctgagggagggctgacatgtaccacatcctgtcagcttgcaaaccagtggtaatctttgcacttccttgttctgaacccatgggctcagaccttcctttgccctcagccccttcccatttgctaggagagccctagggcagctgggatgtgcttgtggcctcgttggtgagcatggtaatcctgagcccacaagctgttacccccctacccctccacagatgcagctggaaacagagaaggagagagtatccctcctggagacactgctgcagacgcagaaggagctagcagatgccagccaacaactggaacgactgaggcaggacatgaaagtccagaaattaaaggagcaggtatggagggtggtctcgggagtagggaagaaaggggcactcatttacccattcgaccatgaagggttcttgggcacttcttatgtgccaggccctgtgctaggtgctgacatatgacaagtacataaaggtatggcacaggctgggcagggtagatcacgcctgtaatcccagcactttggcaggccaaggtgggtggatcacctaaggtcaggagttaaagaccaacctgagcaacatggtgaaacccatctctactaaaaatacaaaaattagccgggcatggtggcaggcccctgtaatcccagcacattgggaggctgaggcggacagatcagttgaggtcaggagttcgagactagcctggccaacatggtgaaacctcatctctacaaaaatacaaaaattagctgtgtgtggtggcatttgcctgtaatcccagctgcttgggaggctgaagcaggagaatagcttgagcccaggaggcggaggttgcagtgagccgaggtcacgccactgcattccagccttggtgatagagcgagtctcaaaaaaaaaaaaaaaaaaaaaaaaggtgtggcacagcagtcagcataacagacattgcccctgctctcaaggaacttacattcctgtggcagaaatggatgacaaatgagcagacacaaagtaaatgagattattacagtttgtgataagtgctgtaaaggaaatagaatgatacaactgagagtgagtcaaaggaggttcactttgcacttagtggtcagggaaggcctcactgagaaagtaacatctgagctgagacttgaaggttagaaagaaaccagctccgtgatacaacataggtgaaccttgaaaacatcaggttaagtggaagagccatatattttatatgatatgcttccatttatatgaaacaccaagaataggcaactctatagaggcagaaaacagatttatggtggggaatggggtggggaatggggattgactgtgaatgggcacggggtttattttgggattgatggaaatgttctaagattgattgcgatgatagttgcacaactctgtgaatatcctaaaacccactacactgtatacgttaaatgagtgaattgtatggtatatgagttatatctcaagccatttgaaaaaaaaaatgcctgccatgtgaagaacactttaggcagaggaaacacctgtcgcaagggccctgggacacagaagagggcttgggaagttcaaggacaaaaaggaggcagtgtggctccagcttgataaactcaggggcgagtggagcggtagccagaagccctgtgtcagccattgtaggagcttggattttgttctaagagcaatgggaaactgttgggtggtatgtatgtatgtatttgtttgagactgagtctcgctctgtcacccaggctagagtgcggtggcactatctcagctcactgcaaccttcgcctcccaggttcaagcaattcttgtgcctcagcttcccaagtagctgggattacaggtgcccgccaccatgcttggctaatttttgtatttttagtggagaaagggtttcaccatgttggccagggtcgtctcaaacttctgacctcaagtgatccacccaccttggtttccctaagtgttgggatgataggcgtgagccaccgcgcctgggcagttggatggtatttaaaaagcaggggtgggatatgatttatttatatatacgtatacatatgtatatacatatatgtatatgtattctctactctcctgagtagagaatagtgtgtgtgtgtttttaggggatcgtggcatcaagtggaagtagggatatggttaggagactgtttccatggtctaggtgagagactattaccaattcatggactctgaccaagaaacctgggtgagccagtgcactttgtgagggaggagagggactaggaagtgagaaggtgaggtggaaacaatgtggattgctggctcctgcctcagcttttgccaccccaccaaaaaaaccagtatttctatgacacagatttcctctactcaatgatttcttatccctcttcaggagaccactgggatactacagacccagctccaggaggctcaacgggagctgaaggaggcagcccggcagcacagagatgaccttgctgccctccaagaagagagcagctccctgctgcaggataagatggacctgcagaagcaggtcccctcctcctccccaccaagtcccatggtccttccccaacacagccaggctttcccacttcctcttgcaggacagggagaaccttggccctgctgcctggtttgggagggtagatgggtgggccacagtactgagtggaaaattagagggtgctcagagttgagcatgtgcctggcagagccctgggatagtaatctctttctctgtaatggtcacagagtttttgttttccctggctgtctcagtttcaattgttctttccgtccttgccaaaaatctaatatttttacatactaggttgcttctcctcagaatcctatatcaaatgatgttctgacttttcatttttaaaaaagcaatcacaatacatgttttgcctttgggagtagttatagtcagcctttttttccttctttttggtgggggagacaggatttcactatgtcgcccgggctgaagtgcagatcataactcactgcagtcttgacttcccaagctcaagcaattctcccacctcagccccctgagtagctgggactacagatgtgtgccatcacactggctaatttttaaatttttatagagacagggtctcactatgttgcccagactgatctcgaactcctggtctcaagcagtctgctcgccttggcctcccaaagtgttgagattacaggtgtgagccaccgcacccagcccagccaagatttttatttgtgcctgcctctatgcagcatatgtgaggctgggaggcagatgaccaggccgaattgtattgaggaagggggtggttaagaacagtgtgtaggaattggtagaatcgccagagcattggaaatggccactgactatggtaaacctcgaaggaccctgaagccctaggtgaggagcatcttcccaccggccccctgccctgccatcttggtcttcatgcccttaattttccaggtggaggacttgaagtctcagctggtggcccaggatgactcccagaggctggtggagcaggaggttcaggagaagctgagagagacccaggagtataaccgaattcagaaggagctggagagagagaaagccaggtaggctagataggccatggaggtggcttttgtctatctggctgccatggtcactgtgatattgacagttgtttgctcaggccaccttgcctttcatgtctgcaactctgggatgtacatgtagccatgtggagaggacatggttcctgtcttcaaagcttgaacttcatttatttagtaaatatttcgtgaacgcctgttatgcaccaggcaccatgcttggggatacagtgataaacaagactgtatggtccctgccccagtagaatttatagttttgtggggaagacattaatcaaataataactcaaattattacaggttatgacacatggaggaaacagggtgagagagagaagagactttagaaccattgttagggaaggcctttctcaggaagttgcatttaaactgagcactcagcatgaagtggagctacccatgtaaaagggtgagggggagttctattccgtaagaggagaaataatatgcaaaggccgtgaggcagataaaagtttacagtgttaactgaaagagtggttggagcctgattggattgtaattggagcctggtgaatgaggagagtggcatgagctgggcaggtccacagcattcaagatttggtaggccacagcaaggagttcgtagtttgagtttcataggaaacctctggagaattttaagcagggaaattgatacaatccaacttatgatgtatttgaagggattgtaatgccatgagacatcaggagtgaaagaagaccattcagagtgaagagcagcttgtattcttagtgctgtgggaatttgagaaggggatgggctgggtgctgtgtcccacgactgtaatcccagcactttgggaggctgaggtgggcagatcacttgaggtcaggaattcaagaccagcctggccaacatgtctactaaaaatacaaaaaaaaattagctgggcatggtggtgggtgcctgtaatgccagctacttggaaggctgaggcaggagaattgcttgaaccaggaggtggaggttgcagtgagctgagatcacaccactgcactccagcctcggtgacagaacgagactccatctcaaaaaaagcaaaaaacaacaaaaaaaagacacagtttgagaagggacacattattttggtggtgaatctagaggcaggaagacaagttaggctggtacagttgtcctgatgagagatcctaaagctaaaccaaggtagggtagtggggaagaggaggagagaagagaagaggtttaaaggatgttaagggagttagaatcaattgtatataattatagattggatgtaggtaggttgaagggagaactctggagtagtcaaggttctacgttaggacactgtgtggatggaagtgccattcactgagctagggaacatagtaggagatgattgggtggacaggggaggagaggaaagggatggggaagatttggacatgttgaacgtgaggtactaatataaggtatgtgtgaaatttgccagagaagaataaggttgatagctaggcatggtggcgcatgcctgcaatcccagctactctggaggctgaggcacgagaatcatttgaacccgggaggcagaggctgcagtgagccgagatcgtgccactgtaccccagcctgggtaacagagcaagactctgtctcaataaaaaaaaaacacaaaaaaacctgtgaggttgaaatggggcatcatctgcaggaagtacctaggagcacttattatagtaagtgctcaataaatgatagcttttattgttacatcataatcattatcattactatttctattttgattattaatgctatgtttagaatactcagatgagaaggtaatttttcattccctaagagaatggcccagcactctgacccctctctttttagcctgactctgtcactgatggaaaaggaacagagactccttgttttacaagaagctgactctattcgacaacaagagctgagtgccctgcgccaggacatgcaggaggcccagggagaacagaaagagctcagtgctcaggtacttcccactctggttatgagctctgcatccctggcagaagcctgattctgaagcggtggattgattgctctgagtcctctcatggagaggacccatctatttttcctgattacaggataggctggtgcctcaacacccctacaggagggggaagccaggactagacaaggcgggggcttgggaatctgacccagagatggacatggctcctgtgggaaacctgacagcccacagcaaagtgcacacgggtgtagcccatgcaggcctggttccagcacaccggcttcaaagtatgctgggtctggttggcaagatgtagcagggagaatgagcaaccagaaatactccagatcaggcaggcagcagcaagacttccagggactcagtctgcccccatcagaaccccagatattgtatacagagaaaagatggaactaggagggaaggaatggggtgtaagagccagatggtggcttgcaggggttaagggcacacaggtttggctgttcaatggtcttgagtttgaatgtaagctttctaattgtgtgaacgtcagcttcttcatccataaaacaagggtgaacaattcttgttcctaattcctataaccattataggaatatataaagtgtcaggaacacaataagcattcaatacatggtagctatgttattgtgactggtcttactaggcgcagcgtcgaggtttcagggcagagttctggtcatagcaaggagccagcatatctgcccaggaagccagggctgaagcccattagcatagcagcctgggcccatgtgttcagtagtcggcaggcagccaggtgttagatctagggtaacactcatttcagagcccctctacctgcctgagagctgagctgaaatcctcccagccctgatcagagtttgtacaaggattgagtggggtctggcctgggaaggcctgaggagagggtatccgcttcctgcttatattatgtaaaattcttccttgacagatggaattactaaggcaagaggtgaaggaaaaggaggctgactttctggcccaggaagcacagctgctggaggagctggaggcgtctcatatcacggagcagcagctgcgagcctccttgtgggcccaggaagccaaggcagcccaactacagctgcgactgcgcagcacagagagccagctagaagcgctggccgcagagcagcagcccgggaaccaggcccaggcccaggcccagctggccagcctctactctgccctgcagcaggccctggggtctgtttgtgagagcaggcctgagctgagtggtgggggagactctgctccttccgtctggggccttgagccaggtgagacagcctccccagaactaggtcctttgggccaaagccaggcctggctcccaggggaaagggagaggaatgctatttgttagaccatattgcttcagggttaagattacatacttgggaattaattctgagtttaagccccagctctaccatttgctagctatgtgtccttgggcaagtcacctgtcctctctgagcttgattttcctcaactacaaaatgaggatgttaaaagtatttaccttatagtttcaccaaggagttatgaggttgcagatgtgaatcacttacacggttcctggcacttattaagtgcgtaataagtgatagctcgcattaatctagcacccaccatagtgcctggcccatacttatggagaaaatatgtgatgagtgaactgctgagaaaggggttctttgcggagaggagggaccagttggaaggacagggctgtgtctggagaggtctggctgtttcttttcatagtggcagccaggtaaggaggttttcctcattttttcagaccagaatggagctaggagcctctttaagagagggcccctgctgactgctctctccgctgaggcagtagcatctgccctccacaagcttcatcaagacctgtggaagactcaacagacccgggtatgtttctctgctcccctttcccgaactctttacatccctggaaaagcatgaggcaaaggggtgtgaagcagtttgacctgttttattcctgagatcaagttgggatgagtttcacctctatcacttaccacctggcaaccacaaatgaagcatttgaagttcctgggccttgttttcccttgcagagtagggcagatagtgcctgctcagggttttgaggattagatgagagaggatcttgaatgagccctgtaaaccaaaaaaccctgggtaggccaggcacggtggctcatgcctgtaatcccagtgctttgggaggctgagacaggtggatcacctgaggtcaggagttcaaaatcagcctggccaacatggtgaaaccccatctctactaaaaatacaaaaattagccagaggtggcggtgggcacctgtaatcccagctactcaggaggctgaggcaggagaatcacttgaacctgggaggtggaggttgcagtgagccaagattgtgccattgcactccaggttgaacgacaaaagtgaaactccatctcaaacaaacacaaaaaaaccctgggcagatgtatggcattgttttccatcatcttccactcagctatgaattaattcttggtacccaggcttccaagagaaaccctagaaatcagtgaccactgagatttgaggttggcatttataggcatgttctaggcctaggtctgaaagagctcataaattccacctcacagtgaacctatcagtcaatacaaattgagtgtcatccatatgtcagccactctgggctgggtatacaaaaaggagaaagacctggtctctgcctaaagaaggcttgtgacatggtggaggaaccaaactgcattctactggaaagcagaactgagagaattaattggatcaataacagacgcaagtgatgcactgttggaactaggaggagggggcaattcatcctgatttgggaagggtcagaaggaaagaagagatgacctttgggctgagctttgaagtaggagtgttgagagggaagtggtgacccctgggctaactttgagcaggagctctgtttcaaaagacatagataggtcagaaggggatggattctcacactccatccaagtggagcagagcctgtcatcacttcaggaagctaaatacacatgtgtttaaaggaagtaacccggcaatctgggagtaggtccacaatggcggcccaccacagaagctgagaatgaggagagagcttgagccctgcattgttttgtggaagatgaggaactcacgtttagccatgcccttcctttcccaggatgttctgagggatcaggtccagaaactggaagagcgtctaactgatactgaggctgagaagagccaggtccacacagagttgcaggatctgcagagacagctctcccagaatcaggaaggtgagaagctcaagacaggcagggagattgagagggagaagggataggtggggagcccagaagtggcaggcacaggcctagcagccactctgtttattttattttatttttgagacgacatctcactctgtcactcaggtttgagtacaatgtcacgacttcggctcgctgcaacctatgtcttccgagcagctaggattataggcatgcgccaccacgcctggctaatttttttggatttttaataaagacggggtttcaccatgttcaccaaccagcggagccaccggggtctctaggagctcctgcacaattataggattgggggctagaagggacctccagtgtcatctggctcaaccctgtctggaattgagggccaaggctctctgtgatgaggatgaggacatattgggatgattaccaggcagcgctggggctggcagcagcagggagtgcttgaactcctggcctcaagtgatccgcctgcctcgacctcccaaagtgctaggattacaggcgtgagccactgcgcccagctgcactgcattatttacccagaaatgtgaggtgagatctagatgcacttccaaaggggtgctgaccaccttgaactattttttcagctttgcttggcctttgaggcccatcctggaagaagagattaggaggaacagatttgatgaactgaaagaaggaaatggctgggcttccattttctgtctctgtagatttaaaaattaaaaaaattggagacccagggccgggactgtaagaacattataaaactgcatcttttgtcatccatgttacttatttttatcatcttcaactgtgtcctccaagttagcctttggtagctgagggattatgagcttatttgggagaaagcaaagagaggggatctggggaggatatatccatgtgccagccaaggactagaaagtgtcatgactccttacaaaggacaggagaggaagggtcttgaagctcaagtttctactgtaaaagagaagagttagccgggtgtggtggtgggcacctgtaatcccaactactcgggaggctgaggcaggggaatcgcttgaacccgggaggtggaggttgcagtgagccgagattgtgccactgcattccagcctgggtgacagagcaagactccatctcaaaaaaagaaaaaaagagaagaggacaccttgggtctgggccttttttgaggccgtttgagggttccctgagagccacaaaaataatgggattccaacgcctgttgcagaaatggtgggcaaccagcagagccacccgggtctctaggagctcctgcacaattataggactgggggctagaaggaacctccagtgtcatctggctcaaccctgtctggaattgagggccaaggctctctgtgatgaggatgaggacatattgggatgattaccaggcagtgctggggctggcagcagcagggagtgctgccaggcaaatagaagcagctggcatctgccagctcttgatgtccttgatatctctaggacactggatataattttctccttcttggccttccttccctttgaatctgttccccatcctccatctgcctctatatccctctatatcccaaacatgggtcttactccactacctctcctctcctctcctcttctcaaagagaaatccaagtgggaaggaaagcagaactccctagaatctgagctgatggaactacatgaaactatggcatccttacagagtcgcctgcggagagcagagctacagcgaatggaagcccaggtaaagtggtactggtttcagggaggggtttgcctcaggagtagtcccttgggcccaccttggcctgtggtcctgtgtcccacttccttcagcaagtctgtcagttcctctggctgtctccatgtccctgggggccattattcaggttccaatgaatcctccttcaattgctttttctgaattgaggttgatatttttgccccttgtcctgaaggaccagcgtctcccctgggcatagcagagtcctggaaggtggtagggatgcccttttacagtatcagcttaagtggaatataccaccactttttttttgcccaagtccttatcactgctagtgccacaaaataagaaagagaagggtcggtgttggggtgacagtagcagggaagtgtagtctaaagtggcttttcatcttgtcttctagggtgagcgagagttacttcaggcagccaaggagaacctgacagcccaggtggaacacctgcaagcagctgtcgtagaagccagggctcaggcaagtgctgctggcatcctggaagaagacctgagaacggctcgctcagcactgaagctgaaaaatgaggaagtagagagtgagcgtgagagagcccaggctctgcaagagcagggcgaactgaaggtggcccaagggaaggctctgcaagagaatttggccctcctgacccagaccctagctgaaagagaagaggaggtggagactctgcggggacaaatccaggaactggagaagcaacgggaaatgcagaaggctgctttggaattgctgtctctggacctgaagaagaggaaccaagaggtagatctgcagcaagaacagattcaggagctagagaagtgtaggtctgttttagagcatctgcccatggccgtccaggagcgagagcagaagctgactgtgcagagggagcagatcagagagctcgagaaggatcgggagactcagaggaacgtcttggagcatcagcttctagaacttgagaagaaagaccaaatgattgagtcccagagaggacaggttcaggacctgaaaaagcagttggttactctggaatgcctggccctggaactggaggaaaaccatcacaagatggagtgccagcaaaaactgatcaaggagctggagggccagagggaaacccagagagtggctttgacccaccttacgctggacctagaagaaaggagccaggagctgcaggcacaaagcagccagatccatgacctggagagccacagcaccgttctggcaagagagctgcaggagagggaccaggaggtgaagtctcagcgagaacagatcgaggagctgcagaggcagaaagagcatctgactcaggatctcgagaggagagaccaggagctgatgctgcagaaggagaggattcaggttctcgaggatcagaggacccggcagaccaagatcctggaggaggacctggaacagatcaagctgtccttgagagagcgaggccgggagctgaccactcagaggcagctgatgcaggaacgggcagaggaagggaagggcccaagtaaagcacagcgcgggagcctagagcacatgaagctgatcctgcgtgataaggagaaggaggtggaatgtcagcaggagcatatccatgaactccaggagctcaaagaccagctggagcagcagctccagggcctgcacaggaaggtaggtgagaccagcctcctcctgtcccagcgagagcaggaaatagtggtcctgcagcagcaactgcaggaagccagggaacaaggggagctgaaggagcagtcacttcagagtcaactggatgaggcccagagagccctagcccagagggaccaggaactggaggctctgcagcaagaacagcagcaggcccagggacaggaggagagggtgaaggaaaaggcagacgccctccagggagctctggagcaagcccatatgacactgaaggagcgtcatggagagcttcaggaccacaaggaacaggcacgaaggctggaggaagagctggcagtggagggacggcgggtccaggccctggaggaggtgctgggagacctaagggctgagtctcgggaacaggagaaagctctgttggccctccagcagcagtgtgctgagcaggcacaggagcatgaggtggagaccagggccctgcaggacagctggctgcaggcccaggcagtgctcaaggaacgggaccaggagctggaagctctgcgggcagaaagtcagtcctcccggcatcaggaggaggctgcccgggcccgggctgaggctctgcaggaggcccttggcaaggctcatgctgccctgcaggggaaagagcagcatctcctcgagcaggcagaattgagccgcagtctggaggccagcactgcaaccctgcaagcctccctggatgcctgccaggcacacagtcggcagctggaggaggctctgaggatacaagaaggtgagatccaggaccaggatctccgataccaggaggatgtgcagcagctgcagcaggcacttgcccagagggatgaagagctgagacatcagcaggaacgggagcagctgctggagaagtctctggcccagagggtccaagagaatatgatccaagagaagcagaatctggggcaagagagagaagaggaggagataaggggccttcatcagagtgtaagggagctacagctgactctagcccaaaaggaacaggagattctggagctgagggagacccagcaaaggaacaacctggaagccttaccccacagccacaaaacctccccaatggaggaacaatctctaaaacttgattctttagagcccaggctgcagcgggagctggagcggctacaggcagccctgagacagacagaagccagggagattgagtggagggagaaggcccaggacttggcactctccctagcgcagaccaaggccagtgtcagcagtctgcaggaggtagccatgttcctacaagcctctgtcctggagcgggactcagaacagcaaaggctgcaggtaagtcactccatggggagtaagggccaggggacacacccctgtctggctgagctcagggactgcccaccaccctgggccctgtggcacctcaggggtatgagaaagctgagatcatgagcacctcaacatcggtgggattcaggctactgtgctagtcgggagatacagagaggataagacccccacagtccctgccctcacagagttcacagtctagtgggtaaacaacgataatgcagtgtggttggtgcctaatgggggaagtttagtatgccccaggcatgctggagggatgcccaccctttcctgggagtgggtcctgaaaggctttctggtaaaagtggtgtttaagattagacctgggccaggcacggtggctcacgccggtaatcccagcactttgggaagccgaggcgggcagatcacttgaggtcaggagttcgagaccagtctggccaacatggtgaaaccccgtctctactaaaaatacaaaaattagccaggtatgctggcatgtgcctgtgatcccagctacttgggagtctgaggcaggagaattgcttgaactcaggaggcggaggttgcagtgagccgagatcgcaccattgcactcgagcctgggcaaagaaacgagactccatctcaaaaaaaaaaaaaaaaaaaatagacgtgaagggaccagtaaggaactagccaagcacaggttgaggaggagcattcacgggaagaggaaaagagggcgagaacaagtgtagtatctgtgtagatggttcaggttgcatgggacagagggaggatttgggaagagaccggaagacagcaggggccacacctgtcagggcttacaagtcatgctgaggacctgggtggtgggaagcagatgaagtttttgcagcaggggagtgatgtgatcagacatacagctcacaaagattgctcaggctgccgtgtggagcaacagcatgtctggagagacccactgggaggctgtactgggaagtccaggggagagcttgtgccctaagatggaaagtgtgaatggagacatgtgggtgggtctgagaggtaggacttgattggctaagaggtgggaggaataaagagagggcagaaagaagtcaaagatgacactcaggttcctgttcatgaagatgaagagaagcaggtgtgagaaagaggagtggaatgaatgatgaggtcagtttggaaatggagggaggagcctgttggcaggtcagtaaaatgatctgaagctgaaggatggagttgaagccagagacactttggagtcatcagcagttagaacaaatgggtttcttgtaggcagaatgttgagtgagagaggaagtgggcttaggagaggacttcagggtgtattatttaacctcaaggtcaagcaccgtgtcttagtcacctttgtacccccggtactgagcacaagacctgcagagagcaggcaaacaggaaagccaagttggctcaagagagagaggcatcatctctttttccaaaagacgcccagtccaattttccagggaaatagactctacatcctggtcccttgactgggccccagagaaccccagacacacagtcccccagagagttcattctgggaactcacaaagctctgctcttggtgaagggcaatatgaggagaaggaggtccatctgtgaactccaaagttcacagggtttgaaatacagtagtgcggcttatcagctgtgtaaccccgggtgaatgccttcactctgatcttcaatttctcatcagtaatataggcattggtggtatgacatggcatgatatgtatgaattgcttaggaagaaagcactaagtggacctcctttcctatgttcaggcccattcttacaggcacagcaaaagtaagttatgtaattgggcaggagggcacttcccacccatactcttgggttactgagcagtattcactcaataacataactctggtcagagtcacttcacccactgccacctccaaacacacagggtgagactcttgtctcaaaaaaacaaactcataaatggcaggactggaatgaggtctgagtcatctgcctctagagcgcaggctttctgtcaccaagctcttcctctctcccaggcaacccacatccacctgcgtacacttgttttctcttgttcatctcttcttgactgttatcatttatgaaccacagggcacctagaaagtatctagcatgaggcttccccatttatccaaagggacttaacctaaggacttgatccatgtttcatggtgcatgtagtcgttttataaatgaggaaattggggtttggggagagcttgtgctttgaccagagtcatatagccactgagtggctatatgggccactgggtacgccacagggcacccagccctgtgtgactcgagagtccatgctgttcccacagcacatcagtgctctgagtcattgctcagccttctaggagatgtgaagtgagctgggggctctgatcctagcttccttgctagctcaccgcatatccttgagaagagcccctctgctcctttgttttacctatctgtaaaatgaaggttctgtactagaatgactcagagcctctaggaaaaataagacaaaagcctgaggagaacattgaaccgctgtttgtgtggaggatgggttggtctggatatgaggttggcaaggtgtgattttgctccatacctccgtaccctaggatgaactggagctcaccagacgggctctggagaaggagcggctacacagcccaggtgcaaccagcacagcagaactggggtccagaggggagcagggtgtgcagctgggagaggtgagctgggggctctgggggaacaggtgacccagcagggagctcctgtccaggggtttgtccccttcccttgggaactgggttcctgaagcttaaacctgccagattggtctgtgtgtcctctgtctgttccctacctgtcttaggggctgcccaggtgagattcacaggtctttcccacaggtctcaggagtggaggctgagcctagtcctgatggaatggagaagcagtcatggagacaaaggcttgaacacctgcagcaagcagtggcccggctggagattgacaggagcaggctgcagcgccacaatgtccagctgcggagtaccttggagcaggtgacccctcttcttgtccagtgggcatgcatctccacttctcgtgtggtccctagagcataggctcagtaaattacagcctgtgggccaaatccagcctgctgcctgtttctgaaaattaagtttgtttttttttttcccgagacagagtcttgctctgtctcctagagctggagtggaatggtacgatctccgctcactgcaacctccacctcccgggttcaagcaatcctcctgccccagcctcctgaatagctgggattacaggcatgcaccaccatgcctggctaattgttgtatttttagtagagatggtgtttcactatgttggccaggctggtcttgaactcctgaccttgtgatccgcctgcctcagctttccaaagtgctgggattacaggtgtgagccaccacgcccagccctgaaaattaagttttattggaatacagccatgcattgtttatggctgcttccctgctatgccccacaaagcctacagtacttactgcaggagaactttgctggcctttgctccagaggtctgagaggctggccctgcctcttctgcttcaggagcacttctttgcactgaggcctgccctagctgtgccttcctcagccaggagttctcttcccatggttactgtcccctcatatacctgcacaggcactggccacctctggagaaaggcagctctgctccaaccacagagccaagccgagccctgatttcttatttgcaccttggcaggtggagcgagaacggaggaagctgaagagggaggccatgcgtgcggcccaggcagggtccctagagatcagcaaggccacggcttcttcacccacacagcaggtttactcattttcctcagctgcagccttagagagcccaaccccagccaccagaaactcagccctcctcattgcatatcccgggccaacagcacttcagctagtccagagagcccctcctgactgcattctgccctgctcggcacagctcagtctgtccctgccctgagaaggaggcccaacattggggtgggggttggggtggctagtggccctgccttctgagggacttagatctgtgtactcccagaccagtgccacagactggcccgggagtggggctcatggggctctgcttaggatccctggtgtatgggggttgtgtggtgcttgccagctcctgaggagcctaggagcttgatcacagcttgatctcttagacctttttacaatgttgagtttataggcttagggtccatggtctttcctggagccagtgtcccttttttgggtaagaggcttggggaagactccccaaactactcgtctaggtgaggtatccctgccaacagacacaggcttgcagcctgacagggaggcgctgtttatggtggctgagcactagatctccatcccttgtcctttattgaaagttctcaagggcaggcaccgtgtcttcctctctgcatccttagctcacagcccagggctagcacaaagcagatacatggtgtacttctgttaaattaaaacatgcctcagagaagcaaatgccatccaggccttttggatgttttgtgtcaggtctccatggcgttgcccattatgctggtgtggggcctctccttgctgcagggcctgctgccccatagacgtccagtctgagttcagatgcttctggcccatagcccttgcccaggcccctaagattgtgatgaggttctgcaaggaaacttgcagaaaccccagagtgggaaggcctatgccaacaagagtgctgtttgtcttccttaggatgggagaggacagaagaactcagatgccaagtgtgtggctgaactgcagaaagaggtatgttctggattttctaagcccatattccctcccttgcactcaggccctttgtgcacctccagcagggagaggggaagttcctcccttcagagaacttcagtctccatgggaggcaaaaatagtcccagtcccaaccccatctctcatatgcctagggtgggagtggggaagaaagcatgatcctggcccccgacttccaaatccatacttagaaagggaaaggagtaggaagagggctgaggagcaggcagaagattctaggaggacaggtgggagcaagggaagccatcctggcctccctgccctcagaggtgccctcgcagccaagactgttgccagtgccccagacagaggagccaggcaccagcacaagctccaggccacacagctcagcacaagctccaggccacacagctcagctcaagccgccactcgcagagaagtgacttgaagagccttcctgcctcttaggcctcaactaaaagtccactctccctttcaagttgcaggaatcataagtgttacctttttatttctgagcctatttcagaaatcagtagtcactactggcagggcctgactctgtagctagacctaagctattactttgaattctattaaactcagaatgtttttctattttattaaaaagtcaaagcaggtgcagtagctcacacctgaaatcccagcactttcggaggccaaggtgggcggatcgcttgaggtcaggagtttgaaaccagcctggccaacatgacgaaaccctgtctgtactaaaaatacaaaaattagctggacgtggtggtgcacacctgtaatcgtagctactcaggaggctgacacacaggaatcacttgaacccgatggggtggaggttgcagtaagccaaaattgcatcactgcactctagcctgggcaacagagcaagactctgtctcaaaaaaaaaagtcagatagtggttatacttgagtatatattgttatcagcctcatcaaaatgtacatttaaaactgggcatttttcacatgtaaattatctttcagtgaagttgatgaatagctttgtggttttcaagcgcgctatttgagtcacatgtgcagccaggattgagaatcactggattctagaattcctaagggcccttcctctaaactctctacagcctgtttctgagattcgtgtatgtggtagagttgattcagatgctcagccaacgagcttcagagaacacagagcaggaagagctgggacaacttcagggccctcagctgctctcccttttttttttttttcctgcccaccaggtggtcctgctgcaagctcagctgactttggagcggaagcagaagcaggactacatcacccgctcagcacagaccagccgtgagctagcaggcctgcaccacagcctctcacactcacttcttgccgtggcccaggcccctgaggccactgtcctggaggcagagacccgcaggctggatgagtccctgactcaaagtctgacatccccagggccagtcctgctacaccccagccccagcactacccaagccgcctccaggtagcagccacagccaggagcacacagacagaagactgtgtcatgggtcatggcccctccgcacacctacaggtttgccaaaggaaaagcctggctctgttaggcacccaggagccccaggtcggcgggtgttcccaggaagaggaagtaaatctgcaaccctggggaggaccccaactcacctgggaatgaggcaaattgcatttgcttgctccctatggaatcacccagaggggtgccttgccctggctgagggacatgtactgcctctcatctagaatttattttcctagcacttcaccacctccttcatcttctccttcaacaataaaccctgagatctttgcattcattttctgctgctgtctccacttgtgcagctgggtggcagcaccacatcaagggagtttatctgggaagaacttgccaaagattcctgttgaggtagcatgcatttattgtacaccatgcactgtgatagggaagggttacagagaacacacaagacaaagcccctgtccacagacagcctacagtccagttgatgagaacaggctaacactcatttatgagtcagaggcaattctgtgtactgactagaagaactgtagaaattccaggggctgaggaagggaggcacgaactggcccttgaaagatggagtggggttggaggtgttgccaagcacacagtgagaagactggtctgactgtggcagggggttggggctgagcttgggtgggttgagcggggagattttggagggttaaaagaagttctggggcctcaaaaacacagcgttgacctttagctaaagtcagagtctctgagttcagaagctccacatggcctcattcctcttctactctgggtgaatgtccttgagatgtcccttcctgggcatatcagctggaactgatctggtcgcctgtagtccaaccatgtgtcaagccaatcagaaggatggactatggcggaacttctcacccatggactggtcctagtggaggctggacagaacccagctcacaggcttaagacctattgctggcaacctcctcaaagcctaaaaattgtttaatttttttaagagacagggttttgtcctgtcttccaagctggagtgcagtggcacaatcacatcttactgcagcctgaaactcctgggctcaagtgatcctcccacctcaacctctcaaagtgctgggattaccggtgtgagccaccatgcccaaccagaacagttttccttaaagaagcaggccattaccttcctctggcactcccaccataatctggaattcctctttactaagcctggggatggaactgagacctagccaagaatctgggaggggtaagagcagcacccactcacccagacctcctaatttggggctcagccccattatgtctcattgcaccacacagagtggaaatggggctgttcacagcgactagagctttgttccagaaacctacacatgcagctcagcaacagatgcttagtgaaaacttctgaaaccccagaaacagatctggggccccagaaatgctgtcctggtccctatttccagtcagattccctgtagcttaaaatccttacctggcttttaggccatttatttctttttcctttttttttttttgagacagagttttgctcttgttgcccaggctggagtgcagtgacgtaatctcggctcaccagtggcaacatccacctcctgggttcaagcaattctcctgcctcggcctcctgtgtagctgggattatagacacgtgccaccatgcccggctaattttgtatttttagtagagacagggtttctccatgttgatcaggctggtctcgaactcccgacctcaggtgatccacccacctcggcctcccaaaatgttgggattacgggcatgagccaccgcgcccggccctttaggccatttttatgctaggagttgtcagagacaagacttctcttggttgttcacttgttacatcctccagccctggttctcaggctcgggctgacagagggtccctgttttttaccttagagtttcttctcagcatcattttctgtaggtcatgagccagggccttaggccccacataccttctgggcctcagagaggttccagcagctgaaagacatcttagaggctgccaagcagggtctttattcaggactagactaatctgtatttgctcttctctttccatccaaccctcaagagccccccagctccattatagacctcggcctagggtctcccctccccaccagatattcagagcagggctggccttcagttcaagtgtagactgtgctcttgccctcacactcgagcttgtggatgatcttccactccggctttctaaagtacactttccttgcccagtagcaggattgcctctgtggagtgtcccaccaataatggtgacaactgctgttttcatcagctccagacccaaagagacctgaagtggggaagtgtgaaggaaggaatatgtgtcatccaggggggacccaactttgcctaagggcatgaggccggagcctcctttcctgaccttgtcacatgtggcagggtataaccagaatggtgaatccagcagacgggaggagtccctggcagtccagccagttctcgtggatgtacttgaggaaggtgcaattggccaccagaacatgcaggagtagaggttagagctcagccacagagattatcttcttgcagaaaacttttttcccccttcctaatcttgtctgctttgatagaagctggtactggctggaaaggcctgaaagcaggaggggacaagagtcgtcagaggctgggcaatgttcttgtttccggggagtgctgaggtccggcgggtgctgcccctgttctctcaaggatcccacgtgctttgtgtgttagagcagtgaccatcacctcccaacccaaggacctttgctgctctgcttcccacatgggactgccagcaccctgaaggcagaaaaactgaatgtacccgttaaaggaggagaagctggtggtgtatgttgagataaggagggtggggagtgtacagttacaggctgcacagggagggcaagatcaatgttgacaccaaagtgccaaaggctgtctgcgccaggtctggggcccccactggtcataccgcctgataaaaccattgcagtccacactaggtctggaggcttcgacacccacagcatgtgggtgttctcatgcaggccatgagtattcggggtgctttaagtgcaggggagttctgttgtccacgttattcttaaagcccagaataggccctgttttattctacagagataggaaggcactggggctcacagagtggtgctgcttcccaccctcacccttctgcccccacctgagcacagtgtggtgctcagtgatggttatcctatattccaaatacgcatggcccaggactggcagagtcggagctcggggtctagctgtgacctggggatcggttggagtagcttcttgaccagccggaattgggttaggtgtcctagcattggtgcctatggagaagaacacagactgtttatcactcacccctggttccagtaccaaggaaaggctggagccattgcaactggaggcccagcggaggaagggatcaagaagaggatgcagcccagagcccaggaccgagcatccaccggcctctggagatggcgtggtctccagttgcatcggggcttcagggcccatctgaagtgctgatcaaaccaggcagacacaccatgctggtgaaggcaggctttgtagatgcggggctgaattgagcagccacagaacctctgcagctctggggccagtggcagaacttctagaagtacctgtggggtgggaaaccccagccacaaaagcagtgagctgacttccaggcctgaggctttgcctgcaggcctcatctcagcccatgggacagattcctggtttttttagtttggccttggggtagatgataccttcagctgtccaccctgcaatacctcacctcctgccttctgacccagtactctgcagagcgggggaatggggccaggggacaggggcagggaagaggaagaagcaagagctgccagtgtgctccaaaccaagagagccctccacatgattctgggcacagctgaggaggagtgcaagctcaactctgctcaccacacttaagaagcaggcaagggaggatgaagggcaaaaacatggggtcctgaggcccttttactccctctaccctgctggaggtgaggatgagaggtgagacttcgttggactgtgctcctggccagttgatctcacccaactcattacatcagtagcctggtcacagggtggacactctgacctcttcttagcctttcattggcaatactaccagctctatatatgcccttatagggcctgaaccttggctcaggtggatgggcttggaggtaaaataattgaatgggtcaggggtaggaggagagatgagtctctgccaaggctgtgtgatgtgtcatctgagagagtgggtaacccctattcccagcacatggccatttatttagagccagggagggggacgagaattcatattcaaatgtgattctttcttaattactaccagttgttcaggtgagggaatcagggaaggccagattaataatccacacattgcccttgcacctcctgtcttggtttcctatcaaaacctctcccgtatctatgaacattccagccctgcaggtcagattgctggccaggagtagtctcacattctagctgactgatggcctcggcttctgctgttgtatgtggtttgatgattcatgctggagcctttggctataactctcttccctgtataagggccatctgaagtttgtctgcctgactccattacctggtgaatgagattggctagctgctgctcctgccccagctattcagtcatttggcaaatactcatttaaacaaagctccacagggagctctgagaaggagctcacctctaggcacacagaacctggacacagatgaaagtttgcagaatgacccagttgtgcagaagagacccactggctgctctcagtgaggccagggagagtcaaacagagcatcttggacaaagagagggcttgaaggccctttcaaagtgtcaagccagttggatgcacgggttgtgtggagtccaggggtacatccagaagcaatggcaggtgttatccattcattcaggttagacctctgagcagacggcagaaacgtcagccacaggtgagcataagctcaaacccccccattgaaggctacattcttgtcccacagggcagagcacatggcaagtggcatgctgactcagacaccgggcactgagaaaagtgggaagccatggtcacagactctacattcccctctcctgttggcctccatcccttcctcaaccgtccgcagaacacctccttccagcaccttagctcctgcctccctctggacctattcagtcctcaagggtgccctgctaaaggctgggctgaaagctaagaggagaggtggcattcaatgtgtcctgtgtcctccctggggttgattaaggggtcgatgcccaatagagtccttcatcttggcgttcagcccagggtccagctgccaagggaaggcttggcaatcaagggtgatggagataagaatgaaaaggggcaccaccctgtgccaaagctggcatgttgtatatctgagagaggagctgcctattcacagtgtagggttgtcaagctggaggcagggagagaaaagcaagagctttttggttcctcttgaggatagaatctataggaaaatgtaagagggttaaaaataaatttcccatgcatccaaacttttttctttggtagactttcttgtcatctatttaaaatgaaacaagtgcatgtacgtggttaagacattttagctaggaatgatggtgcgtgcctgtagtcccagctacttgggaggctgaggcaggaggatcgcttgaacctggaaggtcaaggctgcagtgagccgagatcataccactgcactccagcctgagtgataaaagtgagaccctgtctcaaaaaaaaaaaaaaaattaaagaagttaaacagtgccgggcttgggggctcacgcctgtaatcccagcactttgggaggcccaggcaggcagattgcttgggctcaggaattcaagaccatcctaagcgaaaaaatataaaaattagctcagtgtgatgatgtgcctgtagtcccagctactcgggaggctgaggtgggaggatcacctgagcccagggaggtcaaggttgcagtgaaccatgatcatgtcactgcactcactccagcctgggcaacagagcaagactgtctcaaaaaaaaaaaaaaaggaaattaaataaaaagaagatagcagtttcccacctcattcttctcaaactcctcttcagaggcagcgggttttttttttttttgactatgtttttctactggctcactttattcctctaaaatagtaacttgtctatgtggtgccataacgggtccagtatctggacacgaggccgcactacctacacctttggggattctcggatcctgactctgagctacctcattcctagacacctggtgcaccacaatgtgtcagggatgtcggtttatgtgggatatttgcattttgttaggttgtgtgtggtagttgagcagccaagggggtagcatgcggtggatatttgttttagatacacagtaactggaaactcatttactgaggctatttggttaccctgaactactgtttctaccaaaaaggcaggataaatgctccctcaacacacacctttaattaccaattttcagagtaaggggttgaggtaatagccaccgccagttttccctttctctttgagtatcattatgagctcaaagttttttatatattcactatgattcaatcatgacagttgctatttttgatgctcaaattgccgcaaatctaatgtccaagtgttcttgtacttgtctaggcctagaatcttttagtgaagaaaaagtatttagaagacaaaaatcaggctgagtgcagtggctcacgcctgtaatcctagcacttgtgggaggctgaggcaggcggattgcctgagctcaggagttggagaccagcctgggcaacatggtgaaaccccgtctctactaaaatacaaaaaattagccgggggtggcggtgtgcaccttgtagtcccagctactcaggaggctgaggcaggagaattgcttgaacccaggaggcagaggttgcagtgagctgagatcgcgtcactgcactccagcctgggtggcagagcaagactccgtctcaaaaaaaaaaaaaatacgaaaaacaaaaaacataatctggattgcagggctgatcgttgctaatggagtgttatggctgttcagatgacagagggagaaaatgtactttgtaaactgttagttcaatgaggttatgattgcacaacaatgtgaacatacttaatgccactgaactttattgccattgataacttttaaatggtaaattttgtgtattattttgtcacaataaaaagtttgaaaatcgagttcataatatttccagtttgggccgaccacggtggctcatgcctgtaatcgcagcactttgggaggctgaggtgggtggatcacaaggtcaggagttcgagaccagcctgaccaacatggtgaatccctgtctgtactaaaaatacaaaaattagccgggcgtggtggtgcgcgcctgtaatctcagctactcaggaggttgaaacaggagaatcacttgaactcgggaggcggaggttgcagtgagccgagatcgcgccactgcactccagcctgggcgacagagtgacactgtctcaaaaaaaaaaaaaaaaaaaaaaaaaattccagattgaatttaatgtcacagagtttttagcctgtccacctgcccaattttgtattgtttcttttttttttttttttttttgagatgaagtctcactttgtcacctaggctggagtacaatagtgcgatcttagctcactgcaacctctgcctcccagactcaagtgattctcctacttcagcctcccaagtagctgtgattacaggcagcctccaccacacctggcaaatttttgtatttttagtagagatggagtttcactatgttggccaggctggtcttgaactcctgacctcaagtgatccacctcccttggcctcccaaagtgctggcattacaggcgtgagccaccacacctggcctgtgtctagtttctaatgttgttaatataagtagttatttacttattcaagaccagcctgggcaatatagtgagacctcaactctacaagaaaatttaaaaattagctgagggtggtggcacgcaccaatagtgccaaccattcagaaggctgatatggaaggatcacctgagcctaggaggcagaggttgcagtgagccgtgatcatgccagtgcactctatcctgggtgacagagtgagactctgtctctaaataataataataataccagcactataatgaaaatactgagtcaagtttaaaaaaaaatttttttttttgagacagagtgtcactctgtcgccgaggctggagtgcagtggtgcgatctcggctactgcaacctccacctcccaggttcaagcgattcccctgcctcagcctcctgagtagctgggattacaggcacacaccgccatgcctagctaatttttgtatttttagtagagatggggtttcaccatgttggtcatgctggtcttgacctcctgacctcataatctgcccgccttggcctcccaaagtgctggggttacaagtgtgagccatcgcgcctggcctaaaatttcttcttagttctttttgtccacagagactatcctacaaagaatatacaatcaaggtgttgagtttaaggaacttgaaataattatttctctggtgtttatattatcaattaaatatagttaggtccatttgatgtgttttcaacttcagggttcacttttttctcatttaattttattttttggtaagatacagcataagagagtcacatggtgataagacagaatcagtaatagaatgtagccctttaatgccaccagaaatccagagagagaaataagctagggttttattcagtagcagagtaatctccatccagggtctgcttgaagccctagtccctctctgacaccacaaggtccccttggctacctgtcaagcctcctggggactccactggaaacatctcagccgtagacagcaatcttcctctcacactgcagtttcaagatgatctggtattctgctgggaaattttgcatggtgttctcaaaccaatatttgtcatcccagtaatgggaccaccttttgcaattgtcttccccaaaaccaaacaaggatacctgagagattggataagacaaaagatggtggtggtgtaacgggctggatcctgccctgcccccatggaacacctatcatgccttcagcaccactcactcaaccactagtgtgccaggcttcctcttggagctgggaggagaatggagttcaccttcttcaaggaagacagactctaaatactcatagtgaccccagagcccagaaaagagagcaccaactagttgttcttcattatatattgagagaagagaggattcccctgggagacaagggaagggcattccaggcagagggagcaaggtgtgagaaggcgtgaggcagctggtatgtttggagaaccccaagaagtccagtgcgggaatctgggagagaggagagggagagaggagaggggtcagatcatgtagggtgttgaaagctaggcagaaagttttagatttaacgggaagtccttaggaagacagattttttttttttttttgagatggagttttgctcttgttgcccaggctggagtacagtggcatgatcttggctcaccgcaacctccgcctcccaggttcaagcgattttcttgcctcagcctcccaagtagctaggattacaggcatgcgccaccacgcctggctaattttgtatttttagtagagacggcgtttctccatgttggtcaggctggtctcgaactcctgacctcaggtgatcagcccgcctcagcctcccaaagtgcagggattacaggtgtaagcccccatgcccagccaagaagacagaaattttgagtggcagaggagtgaaagtccgtgagttgcaggagatatcttacctggtcacaggtatgcaaggcatacaacagagccacaaactccaaggacggatactgaccatggttctccagccaactttcctggatatacctgaggaagtagaggctgatcaccagcacctaggaagatggagaaagggactgacctgaagcctgtcccatggctacccactatcatgttgtcctaccactttcccctttccttcctgggaccctcaccttatctttgctgtcttcggttccaccaggaacctgaaccgtctgaaatctaaaaagaaattgaggtttgggaggatttcagagtcatttgacaagcagacttcagccttaagtaagccttgggggtgccccagtatccagccagggtctctttggagttacctctgtcactccctacagtgacctcactccctgacatacccagggttttttttgcttccacatgcttgtctgtttatgcagtacacttatgaaccactccagaccagatgaattcaacggaagcagcagcagttgggtaccggggtcctgagggctggcaatcccagggtacataacgcgcatggtggtcctgttccccacatctgcctcaaagcctcagacaggggcctggttcatcctgaaaaggaagttaggatggtcatttagaggaggaaaaggcttcggcttggtcttcgtctccacctcctaccctgcacccacctgaggaccacttcatgttgattaatcctgaagccaaggccagagctccatagagaccttgagtttcccaccactgcacagacccggcagttggacaccacatggcccagtgggcacaggggaggtgctttaatcagctgctgctgcttattctcaacctccttctctgacttgaccctctcgagtccctaggagcataggagggaagaatttaggggcttgacccaggttccacctacctgtggaagaaggttagagcctggggccttgatggagagatggctaggacctggggttgggtcagggactggacaaagaccaagtttgcgcactgaccagccacaatatcagagcatcattggacgtgggatcttgtggcctctgtaggggttcaacggtactgtcgaagcgtctgtcaaaccagtcagactcgccaggcacgtggaggcaggcagagcatgtgtggacctcagatgagcagttgcattttctggaaaagttgctgggatggtggcagattcctgggtgtatcttggccatattacggaggtccttctggctggagtgctggtgtaggaaggaggtgatcagccacaatgaaaggacataggcagccaccaggcccaaactcctgtatcgaatcatgatctctggccctgatgatggtgcccctggcagacagtagattggccccgacacctggcaccgggaagaagaggctggggccacagaagtccccagcatcccccatcttaatggcttccatccctctcccaacccttgacattacacctcctcccaaaacctcgctcctgcctccctggccacctactgatcactactggaactgccaaagcctggcctagaggcagaaagaaagggagagaggacactttttgtgttctgtggcctccctgaggaaactgattcctaatggggtcttctgtgccagcccagtgatatcagggactcatcacagaggccacgttgtgacctactccaccaaggcccctccttcaccttggcattcagcccagtgcccagatgaccagggaggtgtggtagtcaagggtccaggggacaggagggcacagagggagaggttgtatccaggctggggtgggtgagcaggaggcaaagagggaaacagaagggccaccttggcgatggctcacacctgtaatctcagagctttgggaggccaaggcaggaggatcacttgagcccgtgagttcaagaagggccacctggaatcttctgaagagaatttactatactgatgaaagagaatatttgatacctttagcccttaacacctctcaggggtcgactttttctttttaagaactgtttttttgtgttttttgtttgtttgtttttttgagatggaatcttgctctgttgcccagatcttggctcactgcaacccccgcctcctgggttcaaatggttctcttgcttcagtctcccaagtagctgggactgcaggtgcacaccactgtgcccggctaattttttttttacttttagcagagacggggtttcaccatgttggccaggctggtctcaaactcctgagctcaagtgatctgcctgcctctgcctcccaaagtgctgggattacaggtttgagccactgcgcccggccaatccagtgtatatcttacacttatagtgtatctaaattcaaagcgttttgtcagaaatacatgatttataaatttcataaaattttacagtcaaaaaagatttacatacccaagttacaataagcatagtgaaaagttttctaagaactgaattgttttgaaatttagattaattaaaataaatttaaaaattccttcctcacttgcatttgccgcatttcaagtgctcatccatcatattggatggtacagaaatacaggctaatttaattctaaaagtcaacaatctactattagtgtttacattattgtaactagataaatatttcctatagagtttgtaaatgaactaagactacctttttttgttcatgataattttttttttttttttgagacagaattttgctcttgttgcccaggctggagtgcaatggcatgatctcggctcactgcaacctctgcctcccgggttcaagcaattctcctgtctcagcctcctgagtagctgggattacaggcgtgcaccaccatgcctggctaatttttgtatttttagtagagacggggtttcatcatatcagtcaggctggtctcgaactcctgacctcaggtgatccacccaccttggcctcccaaagtgctgggattataggcatgatccactgtgcccggccttttgttcgtggtaactttctaagaaagggtgtgtaggagataaaacattctaagtttgcatgtctagaaacgccattattctgcttgcaggaggtagaattgtgttactttaaaaaaaaaaaatctttatgttctcacccctgatacttataaatgtgaccttatttggaagtagggcctttgcagatacaatgaaattaaaatgagatcatgctggatgagaatgggccctaatccaatgactagtgtgtttataagatgagggaaattggccgggcgtgatgacccatgcctgtaatcccagcattttgggaggccaaggcaggcaggtcacttgaggccaggagtttgagaccagcctggccaacatggcgaaacccagtctctactaaaatacaaaaaattagccaggcgtagtggcgggcacctgtaatcccagctactcgagaggctgaggcaggagaattgcttgaacctgggaggcagaggttgcagtgagctgagatcatgccactgcactccagcctgggtgacaagagcaagactccatctcaaaaaaaaagatgagggaaatttggaaacagaagacacaggggagtatgccatgtgaagttggaggtagagactggagtgatgcctctgatgcagggcaggcaatccccaaaattggggcttagcctgagagggttcttggctttgccctgatgcgatccagtggtgttagcaaactgtattgaagcagcattgcacagcagcagcagaggtacactgcttcttgtggacagggctaccccataggcagtgtgcccagagttagcagctcagcagcagctctgcaatcctatttatacccacttttaactacatgcaaattaaggggtgaattatgcagaaattttccaggcacaagcagtcctcctgcctcagcctcacaacatgctgggtctgagccactgtgcccagccaaaagtctgattttttattctttgttaactgtagcagttggattcttggtcttggtcaacagactggtaaacttcagagaaaaacaattcgccggctaaatatttagtagtttacaggatgatgcaaaagctagagaaccaggctcagtctatcatgagatgcaaaacatggccaaagactaccccaggaatggcccaccaggaatgccaccactgctgccaacacaactgggcccttgacactgtggtagtctcattatggcagattctcttcagctctttccattaggaagagcagttcatttccccacttcttggatcttggatcactttatgacttgatctgaccaatggaatgctgcagaagtgacacggtaagtgctaggcacagtgactcacacctgtaatcccagcactttgggaggccaaggcagtaggattgcttgagcctaggagttcaaggccatcctggccaacatggcaagaccccctttctacaaaaacaaaaattaaaattaactgggtgtggtgacatgcatttatagtcccagctactcagggggcttaggtgggaggatcacttgagcccaggaggtcgaggctgcaataagccatgattgtgccactccattccagcctgggcaacacagcaaactcttgtctcaaaaaaaaaaaaaaaaaaaaaaacgaattggaactgaggcacctaaaaaaactgggaacctcaaaatgctaaaccttctgtgaaaagctgggcaaaaaaacaaaaaacaaaaaacaaccctcaccctccggcatgggtgaaacaaggaggtttacttcttttatcgaagtgggtaaagagcctcccccaacaactcaaagtctgggtttgcacttggcatgaaattgaatctaaacttatacctcctacatgatccagggcactaggcaaagaaatcaactcaaatattgcccctgagatctggaaggcacctctggcccatccctcccagacactgtggttacaggtaagacaatcaggccaggattttattcagtaccagactgatcttacaatttcctcctgccctttacccacccagaaataggatttgtatggactcagctaggctgagcttgtgtgaatagtgagcttgtccacacgctagctgatggatgacttcgatttctgctcctgcactagacgtgggcagtatttccttggagcccttggtctgattatcctccttccagtgatagaaacactttccttgctattctgatccaaatccaaagagggtgacctagtggataagagagggacatgtgcgtcagcaggcagactcctgtcctcacccctgcctcccttcactcagcatctaggatgacaggttgtccctgggagctgggaggagactggagctcacctccaggaaacagactctggacactctcctagagtcactgaggatcccaaaaaagagaatgtcaactcgcttttcctcatggtattggaggaagagaggggaacccccaggacgtaagagaagggcattccaggcaaacggaatggtgcgagagaaggcatgaggcagctcatgtgtctggggaattctaagagcccattatgggagcctgggagacaggaggcaaggggaggagtcagaacatgtatagtctttttttttttctgagatggagtctcgctctgtcaccaggctggagtgcagtggcgcaatctcggctaactgcaacctctgcctcccgggttcaagcgattcttctacctcagcctcccgagtagctgggactacaggcatgcctggctattttttgcatttttagtagagatgaggctaccaccatgcctggctattttttgtatttttagtagagatggagtttgaccatattggccaggctggtctcgaactcctgacctcatgatccacccgcctcagcctcccaaagtgttgggatacaggcatgagccaccatgcttggcctacatgtagagtcttgaaagccaggcagaaaactttagactccatgctgaaggcattgaggagcaggaattttaagagaagaagatacaagaatctttcctgccggggcacagttgtgcaagacacagaacaaagccttgggccccagggatgaccctgaccctggtaagacagccagttgtcctggttgcacctggggaggaagggggagggaactgacctggggcccttcccacagcaacccacagccacatcctaccccttttcctattccccctcaccgtgtctttgctatcttccactccactagggaaccagaccatcttccaaaatctgagaaagaattggaggtgggggagtttgggccacaagacctgggaaagtcctgcaagtgtccccagtaagccaatagaaggtcttcccagagcccctgctgttactccctgcagtgacctcccctcacccccacacagagaatgtctggggacacctccatcaccttatcacttagagcatctgaagtccacaccaggtcagagagcttccgcagtagcatctccagctgcatccaggagccctggtcgctggcattcctgggatagatgaagcattgtgtgtggtttggttccccacgtccatctcaaagccctggacttggggcctgcttcatcttgggaaggggagcagaaactgatggaactgtggggcaggcctggccttcctgctcccgccctctccccagcacccacctgaaaaccacggggtattggtcgatgtcgttgccaaggctggagccctgcgggatctgtgggcgccccaacagcacacaagtcccacaatagaaatcaaaatggctcaccgagagcctgggaatccctttaaacagcttcctccacaatttcccaagctcgctccctgagttcatgccctggaaacagcaagagggagattgggggctgggcccaggggagagaaaacagagctgggtgggtgagatctccatccagaggctgtgaagacagggccaagggcagggatttgggcggaaagtgggagatgggtgaggcccggaaagcatgggggatatggccgggcccagtgttgaccactgaccaaccaccagagcacagtgtcagaggtcatagactctcttgtcctcatcaggtaccccatagtcttcctggagcacgcatcaagccagttccattcgtcggctgtgtggtggcaggaggagcagttgagggtctcagaagggcagccacacttcccggaactgaaccaagggcagtcgcaatgctgtggtaccaagtacattcgtttttcctggggtgctgattcaggtgtcagatccagatagggggtcatcagccagaggatgagcacccaaaagacccacaggacaaaaatctgccagcgcttcatgtctggcccaggcggtggctcccgtggtgggccgtagactggcttctctacctgtaaggatgaggggctgaggccacagacagcaccagcttccctctgtcctgtcggcctccacaactccccatcccaccaccttccacctccttccaacccctcctctcctgcctcactatccatttgctcaccctcaaaacggtctctgactgggcatggggtggaagaggccagggcagagagacagcatgtggctagtcctgagaggggaaggaatacctcagtgggggccttgctgtcatcccagttatatcatagatctcatcacaaagtacacattgtgacctccctcctttagcctgcctgaaaaaagccaccaccctaccctttctctgacaccgaaatgacctccactggatgtaagattcatgaggacaggggctgacctagtctctcttcttcacctctgcagctctaagacttagaatcatttaataaatatttatgggataaataaacaggggttgagagggaactttttttttttttttttgagatggagtttttgctctgttgtccaggctggagtgcagtggcatgatcttggctcactgcaacttccgcctgcctggttcaagcgattctcatgcctcagcctcccaagtagctgggactacaggcatgcgccaccacgcctggctaatttttatatttttagtggagacagggtttcgccatattggccaggctggtctcaaactcctgacctcaagtgatccgcccacctcagcctcccaaagtgctggaattacaggcgtgaaccaccatgcccagccgggaactttatttttaaattattattattattattattattattattattattattattttgagacggagtttcactcttgtcgccccagctggagtgcagaggcacgatctcggctcactgcaccctctacctcccgggtttaagtgattctcttgcctcggtttcccaagtagctgggattacaggtgcccgccaccacgcctggctaatttttttgtatttttagtagagacggggtttccccatgttggtcagactgatctcgaacttctgacctcaggtgatccgcccgccttggcctcccaaagtgttgggattacaggcatgagccactgcaccccgccccagcctggaactttaaatatacttgtgtgtgatgccctctctggagttgtgtgacatcaactcaatcctctcttgtagtctctagaccccatatccaacagcctactgaattgccacttagatggctcagagacatctcacctgaataagcctgagactgaacccaggattttccctgtaaaccaacccttcccaaaacttctctgtctcttttgttttgtttgagacagagtcttgctctgtcacccaggctggagtgcagtggcgcaatctcagctcactgcaacttctgcctcctccggggttcaagcaattctcctgcctctgcctcccgaatagctgggattacaggtgcgtgccaccaagcccggctaattttttgtatttttggtacaaacgggattccaccatgttggccaggctgatctcaaactcctgacctcaggtaatctgcccacctcggcctcccaaagtactgggattacaggcgtgagccactgcacccagcttcaaaacttctctatctcaacaaatggttccaccacgtacccagttattgaaaccagaactcatgtgttattaattcctcctactcctatgatacccaaattctttttttttttttttttaggacaaagtctcactctgtcacccaggcaggagtgcagtggcacaatcttagcccactgtagcctctgcctccaaggttcaagcaatcctttcacctcagcttgccaagatgctgggactacagaagtgtgccaccacgctaggcttatttatttatttaatttatttttgaaacagagtctcactctgtcgcccaggctggagtgcagtggcacaatcttggctcactgcaacctctacctcccaggttcaagtgattctcatgccttagcctcccaggtagctgggactacaggcgcacaacaccacacctggctcatttttgtatttttttggtagaaacggggtttcactgtgttggctaggctggtctccatctcctggtctcaagcaatccgcccacctcggcctcccaaagtgctggaattacaggcgtgagccaccgagccttgctgatttttttttttaagtagagatggggtttactgtgccagccctgtctcgaactcagctcaagtgatccaccctcctcggcctttcaaagtgctgagattacaggcataagccactgagtctggcctcaaatccattttttaattcgtttctatttctaagtcatcttcttcatctccactgccacccccttaattcaattgtagtcttgtaaagatagtaaaaaaatgaaaatgtttgagttgtttttaaagtttaagaaaaaaacagaacattttggtttttaaaaaaaatcaaaacattttattcaatgggataagaacagtaaaattcttcatcttaactagtggaaagctgcactggatattgtatagcttttaaatcaattcacccaaatatctgagtaaggtgtgtaggctagttaattatatcataccaacgtcaagttccaggttttgaaaaagtaccatatgggctgggcgcggtggcccacgcctgtaatcccagcattttgggaggcaaggtgggcagatcacctgaggtcaggagttcgagaccagcctgaccaacatggagaaaccctgtctctattaaaaatacaaaattagccaagcatggtggcgcatgcctgtaattccagctactcgggaggctgaggcaggaaaattgcttgaacccgggaggcggaggttgcggtgagccgagatcgcaccactgaatgtgattttagctgggcaaaaagagtgaaactctgtctcaaaaaaagaaaaagaaaaattactatatgtattatatggtaagacactaccattaagagaaaatgaaggccaggcacagtggctcgtgcctgtaatcccagcactttgggaggccaaggtggggtttgaagcttgaagccaggagtttgagaccagcctgggcaacacagcaagactctacacacacacacacacacacacacacacacacacacacacacacacaaaaaattagctgggcttggtggtgtgcgcctttattcctagctacttgggaggttcaggtgggaggatcacttgagtccaggagttaaaggctgcagtgagttatgatagcagcactgcactccagcctgcgtgacagagcaagactctgtctctaaaaaaaaaaaataaagcaaaaataaagaataaaatgggaaaatggatgatgggtacatgggaattttctgtactatttttacaatttcttgtgtgcctatggttttttcaaaatgaaaaggttttaaaaattatctaccagcctgggcaacgtagggagaccctatctctataaaaaatataaaaattggccattgtggtcccagctactcaggaggagactgaggtagggaatacttgagcccaggaagtcaaggcttcggtgatatgtgattgcaccactgcactccagcctgagtgacagagtgagaccttgtctcaaagaaaaaaaatcatttaggaaaagatgtatagcaagttttattgctatttcatttacatcaactgctataattttttttcttttttgagatggagccttgctcttttgccaggctagagtgcagtggcatgatctcagctcactgcaacctctgcttcccgggttcaagagatgctcctgcctcagcctcccgagtagctgggactacaggtccgagccagcacgcgcagctaatttttgtatttttagtagagacagggtttcaccatgttgaccaggatgatctcaatctcttgaccttgtcatctgcctgccttggcctcccaaagtgctgggattacaggtatgagccactgtgcctggccaactggtataatttttaaaatttttgtaaactcataaaatttaccattttaaccattttaaaaatattttggccgggtgtggtggcttatgcctgtaatcctagcactttgggaggctgaggcaggcggattgcctgagctcaggagttcaagaccagcttgggcaatatggtgaaaccctgtctctactaaaatacaaaaattagccaggcgtggcggtgtgtgcctgtaatcccagctacttgggaggctgaggcaggagaattgcttgaacccaggaggcagaggttgcagtgacctgagatcgcaccactgtactccagcctaggcaatggaatgagactctgtctcaaaaaaaaaaaaaaaaaaaaatatatatatatatatgtgtgtgtgtgtgtgtgtgtgtgtgtgtgtatatatatatatatttttattttatataatatatataaaattttattttaagttccaggatacaggccaggagcagtggctcacgcctgtaatcacaacactttgggaggccaagacaggggagggggatcacaaggtcaagggattgagaccatcctggccaacatggtgaaaccccatctctactaaaaatacaaaaattagttgggcatagtggcgcgtgcctgtaatcccagctactcaggaggctgaggcaggagaatcgcttgaacccaggaggcggaagttgcagtgagctgaaatcgaggcactgcactccagcctggtgacagactccatctcagaaaaaaaaaaaaaaaaagaaagttccgagatacatgtgcaggtttgttacgtaggtaaatgtgtgccatggtggtttgctgcacctatcaacccatcacgtaggcattaagccctgcctgcattagctatcctgatgcgctccctcccactggcctgcccaccaggcaggccccagtgtgtgttgttcccctccctgtgtccatgtgttctcattgcattttatccatttttttaatgtgcaaccatcatcactatctagtctcagaacacattcatcattccaagcatactctagtgaataatacattgaataagactagaatcaattacatgacattcatatccccactacccattttttccagatcttagcatttctttgcttttgctgttctggtgtttaggtatgaatatatgttcatttatcctgttacagtacattcaggcttcctaaatatgagaactcttgcctttcatcaattctgggtaattctcagccatttctttcaaatattgcctctcccttattctcagtatttcctcctattaggaaactcctattaggcaaatgttggattgtttttctttctatccttcaagtatctgaatctctcttttacatctatgattttatttctctatattacattatgggtaatgtttttcagctccatctttctgttcaatatttctctctctctctctcttttttttttttttttgagacggagttctcactctgttgcccaggctggagtacagtggccccatctcagctcactgcaaccaccttccaggttcaagcagttctcctgccttagcctaccaagtagctggtattacagacgttcatcaccatgcctggctaatttttgtatttttagtagagatggggtttcaccatgttggccaggctggtctcaaactcctgacttcaggtgatccacctgccttggcttcccaaagtgctgggattacaggtgtgagccactgcacccggccaatatttctctctttaactgtgcctaattggttgtttagcccttctactggtttttaaacttaaatgactatttttcatttctagaaattctttgaaatgtactttcacttttttttttttttctatggagtctcgctctgtcgccgaggctgatgtgcagtggtgcaatctcggctcactgcaacctccacctcccaggttcaagcgattctcctgcctcagcctcctgagtagctgggattacaggcgtgcgcctgccatcttgggaaagtcagttcacctcttggcttcctcatctataaaatgagacttgaagtagcacctaggctgcgcatgcgctggctcatgcctgtaataccagcacttttggaggctgaggcaggtggattgcctgaggccaggagttagaaaccagcctggccaacgtggcaaaaccccatctctacaaaaaatacaaaaattagctgggcatggtggtgtgcacctgtaatcccagctactcaggaggctgaggcatgagaattgcttgaacctgggaggcagacgttgcagtgagccaagatcacgccactgcactctagcttgagtgacagagcgaaactctgtctcaaaaaaaaaaaaaagcacctaactcccacgttgttttgagggtgaaatggattacagcaatgggcatattgtccatgttcagttagtattagtttctccttgtctttgctccttccttggtgagctgcggtcaggctgccacagtcacccaactccagggtccctcctcttcctttttatggaagcattccctaacccagcatgttagtcaccttcccttacagactcccatggtccccctgtgccacctcttatcaaagttttgatcttaagtcattgaatgatttgagctatgcactttgaaataaaacagactggagtttagatattagcttattagccactcaaagcttttaatcagggataataatagcagttagcatctaaggttgttgtttttgttgttgttttgtttttagagacagggtcttgctatattgcccaggctggtctcaaactcctgggcttaagtgatcctccctctcctgcctcagtctcccaagtagctggaactataggtgtgtaccactgtgcccggcctaaggttgttgtgaagatgaactgacatgatataggtgaagataaaagagtttacaacagggcaggtgcggtggctcatggctgtaatcccagcactttgggaggccaaagcgggcagatcatttgaggtcagagttcgagaccaacctggccaacatggtgaaaccccatttctaccaaaaatataaaaaattagccaggtgtggtggtggacgcctgtaatcccactactcgggaggctgaggcatgagaatcgcttgaactgggaggtggaggttgcagtgaactgagattgcacaactgcactccagcctgggtaacagaatgagaatctgtctcaaaaaaaaaaaaagagtttaccaccatatttgccacatagtagtggcttgacaaatgctaggtattttttttttttgagatggagtctccctctgtcacccaggctggagtgcagtgatgcgatcttggctcactgcaacctctgcctgccgggttcaagccattctcctgcctcagcctcccaagtagctgggactacaagtgcacgccaccatgcctggctaattttttgtatttttagtatagacaaggtttcactatgctggtcaggctggtctcaaactcctgaccttgtgatcctcccacttctgacacccaaagtgctggaattacaggtgtgagccactgcacccggccaatgctagctattttaaaaaaatattattattagctattatttttatttttattattttattaagggatatattaatatccataattaggactgtaactttctttctttctttttttttttttgattcggagtctcgctctgttgcccaggctggagtgcaatggcacaatcttcggctcactgcaacctctgcctcccgggttcgagcaattctcctgcctcagcctcctgagtagctgggattacaggcgcccaccaccatgcccagctaatttttgtatttttagtagagacggggtttcaccatattggccaggctggtcttctggcctggctggtctcaaacttctgacctggtgatccaccctcctcggcctcccaaagtgctgggattacaggcgtgagctaccgtgcccagccaggactgtaacattcttgaaggcaagaactgttctaattcaactctctcttcccaggactcaacacagggcagggacacagtgtgtgtgtgtgtatatttgagtgttgcttgcatacatggatattacattttaaaatctgaatttagtgcaatttttaatttttattttttaataatttttattttattttatttattttatttaattttcagacaaagtttcactcttgtcctccaggctggagtgcaatggcatgatcttggctcactgcaacctccacctcctgggttcaagcgattctcctgtcttagcctcccaagtagctaggattacaggcatgcgccaccacgcccggctaattttttgtatttttagtagagatggggtttcaccatgttggccaggctggtcttgaactcttgacctcaggtaatctggcctcctcggcctcccctagtgttgggattacaggcgtgagccaccacccctggccttttttttaaagtatttttgatacagggtctcactctgtcacccaggctggaatgcagtggcatggtctcgggtcactgcaacctctgccccccacccctgggttcaagcgattctcccacctcagcctcccgaatagctgggattagaggcacccgccaccacacccagctaagtttttgtattttttggtagagatgggattttgctatgttggccaggttggtctgaaactcctgacctcaagtgatccacctgccttggcctcccaaagtgctgagattacaggcatgggccaccgcgcctgggcttagtgcaatatttgaggcactcagattttttttttcctgtgctgctggttttggtcctatgtgggcaataaaacaaggaacctttcaggaaagtacttctcacactttaatgtgcatgctaattatctggagagtcttgttagaatgcagattctgattctgcaggtttggggtggggactgggattctgcatttctaacaggttcccagataaggccaatgtttctggttcaaggatcccacttagggtagcagagctttagacttaattccatcagcagattccttattacctatttctgatagaattcttggtgctctcaggaatctgaagcccagataatagagggagatcccaggtgtcctctgccaccctgttagctgagggagacccaaaaactttggcttccgtgaaaagtcctcctccagttgtccccaaagttgtagcatgagtccttccaaatcttttctcatgattatacaaatacatattcccccatataagattaagatttttatatatagatagattttttttttatttaggtttttttttttgttttttttttgagacggagtgtggctctgtcacccaggctggagtgcagtggggcaatctcggctcactgcaagctccacctcccaggttcacgccattctcctgcctcagcctcccgagtagctgggactacaggcgcccgctactacgcccggctaattttttgtatttttagtagagacagggtttcaccatgttagccaggatggtcttgatctcctgacctcgtgatccgcccgcctcggcctcccaaagtgctgggattacaggcgtgagccacagcgcccggcctatgttttacatatataacaatttatatataactacatatataatatatataacagtttatatatatatataacagtttatatatataatatatataacagtttatatatatatataacagtttatatatataatatatataagtttatatattatatataacagtttatatataacagtttatatataatatatataagtttatatataacagtttatatatataatatatataagtttatatataatatatataagtttatatatatgtttatatataatatatataacagtttatatatataatatatataacagtttatatatataatatatataacagtttatatatataatatatataacagtttatatatataatatatataagtttatatatataatatatataacagtttatatatattatatatatatatatgcacacacacaaagagagagagagagactcgctctgtcgcccaggctgtagtgcagtggtgtaatcacagctcactatgaggcaggagaacagggaatcagggtaaccgggggttaagacataagcaaatgaaggggtgcagccagttctaggcagcatacaggccacatcttcaatcctatgataacgagacagaagtttccacttccgcctccgattgaccgtggggccaaatctccacttcagcctctgattggctgtgggccaagtctccacttcagcctctgatttggtcgcaggccaatccttcataggtgtagccaactggaggcttctaaagggcacctaggggtgttgccaggtccctttagcttaatacaaaccctgattgaggaggctcttgagcagcttgctctaaccagctgccgctatgaatcgtcttcaataaatctatgcttttgttattccgttcttctgttgctgtttgtctttcgttgcccttctgttactttatgtgttttgttcaacacgccaagaacctggacaactctatgctggtaacaactgcaggtaacctggtaacaactgcagtttcaaactctcctgggctcaaccccagcctcccaggtagctgagactatagacgcatgccaccacacctggctaatttttttatttttatttttatttttggagacagaatctcactctgtcgcccaggctggaatgcaatggcatgatctcggctcactgcaacctccgcctcccaggttcaagcgattctcctgcctcggactcacaagtagctgggtttacaggagcacactaccacgcctggctaatttttgtatttttagtagagatggggtttcaccatgttgaccaggctggtctcaaactcctgaactcaagtgatgcttcctggctcggcctcctgaagtgctagggttacagatgtagtttttaaagtttttgtagagtggggtcttgctgtgttgcccaggctggtcttagactcctggcctcatgtgatcctcctcggtctcccaaagtgctgtgattacaggtgtgagccattgtgcccagcccaatttttaattaaaaaatggaatgatggaatgcacattactttgcatcttttcccccttaaaaatacattcttagtatacctaaaggagtaaatctacctcattcttttgaaaagtggcctaatattccatagaatgggtgtatcgtgatttattcaatttatttaatgtatcagtgggcattctggctggttccagatttttgccattgaacaatctcatgcatacatctttatgatgtggtgcacttaaaatctttaagagacagattcaatatcttaaggtgtaacaaccacccagatcatggtacttttatccttatattaaaatttttttctgttaaccttggatagctgcttacatattttttcttttttaaaatttttctattaaccttgacatggtgcttttacttcctaaagtggaattcctgtatgaaagcctatgagcttttatatcttactcattgcagctgcattactgtgggagctgtccctctagagacactgggctgcaatgggaagtgtcagggagagcttaagctccatatcacttgagtctaaacctggagggatagagcgtgtccgtgaggatcccagggcctggagagcaatttagggtaatattcagaaagcagcgctcaggagaagcactgggacgctgtttaggtaaaatcaacccaaaagaccctgattcccagagtactttgaggtccagaagaactgggctggaagcaggtcctgctattaattggctgtgatcttgggcaagttatttaacttctccaggtcacagtttgctctttggaaaacggagataagtcacacctgctttcagggcggacacccttactttacatcagaatcatccgatgccattcctagcgtttcggcttcagtaggtgggaatcaattatttgcatttctaataggtaatcagttgataatgatgcggccggtccggtacactcgaaaaaccactgttccaggatattccaagatgttccaagagtcttaaacacctggtgcagttccgagcacaaggcacacgaacggtgctattagcgtttctaaccccgcagagaactcctcgcaccccagtcctcaaaatcccgccccggacagcggaggcccgggcagtagcttccagacccaattgcccgcgcaagggggcgtggcagcatcgttgggcggggccgcctgtaagagaacgcggctaaaggtggggccaagcgtgcggtttgctgcgcctgcgtgaggaaaaagaggggggcgtggctccaggccggaagagggagtctgtaggggcgggccggctggcgtcccctttccggccggtccccatggaggcgctggggaagctgaagcagttcgatgcctaccccaagactttggaggacttccgggtcaagacctgcgggggcgccaccggtaggccgcagcggggccggggtcgcgtggaggggggcgtcctagagcttagcccgggctcctggactctgactggcctgccggtgtctgagggagcggattcgaggccattctgaccctcgccccttgtcctgcagtgaccattgtcagtggccttctcatgctgctactgttcctgtccgagctgcagtattacctcaccacggaggtaaggggcggggcttagtgcgtgggcggggcttggcattctaggagtaggacctttaggggtgggagtggggaaggagaggtttggggctaagtcttactgaggtagcgctgccccaggtgcatcctgagctctacgtggacaagtcgcggggagataaactgaagatcaacatcgatgtactttttccgcacatgccttgtgcctgtgagtacctcaccatgggtgggactggagagacccagggttctcatgtgggctgccagattcacacctccacccttaggttctggactggaccccaggacaacctccttctcctcatcccgttctgccccaagacaggcccagtatccccttcccctccaaaacccacatccccttgtccctagggtcccagtaccttagcctgattttcctgcttccagatctgagtattgatgccatggatgtggccggagaacagcagctggatgtggaacacaacctgttcaagcaacgactagataaagatggcatccccgtgagctcagaggctgagcggcatggtaaccaggggagggggccgggtctcagatcccaaagctggatgtacccaagcctatctgctagcaagtgaactgtggcaggcatagtgatacattaaacaactaagagctagagaagtcaagtgacttgcctagggtcccccagctagtaagagtcagagtgagctaaaatcctctatacatatcgagtcaggtaatctacctggctattattctcagaggtcctcaatacctgcagatggtagtttgaataccagaggtttgaagataggtcttatgtgctcttgccttggtagaactgtctagatggacccaggcttctttgagtgtttgctttcccagcccattggcttaattcagcccttaatgctcttcccctttggaatgcaggtggtttaatgagaatttaggttctcaagtcagattgcctgggttcacatctagctttgtctcctgcagtctgtgagcttcagctagaaagtggtaataaaacagtagtaccaaccacatggaattgtaagatcaaatgaagtcatatgtgtaaaatgcctggtacagagtgggtacccacttttaccttcctttcctttatcttggtggcttcccaattcccttcgttaactcagtttcccaccacagcaaactgtcctcaaagctgggatttctaacaccttagagattactctggtggggagttttatcattcgttgtttcagcagattaatgcaggacaccagtggaaccaacataatttgctataggactggatgtggagtggaggagagcaaagtcatggttgttgattccaacgctttcagcctgagcaaatgaatgacttgagatggagatgactggaggagaaggtttttttggtgggagggaggagtggctattggatatccactgctgtgtaacaaagtactccaaaagttagtagtttgatacaataaaaatgtgttttttcagtttccctgggtcaggaatttaggagtggcttgtttgggtgattcgggattagggtatctcacgaggttgcagtcatctaaggattgatggggcactgaagaatctactatctatctatctatctatctatctatctatctatctatctatctgtctatcttgagacagagtctcactttgtcgcccaggctggagtgcagtggcgcgatcttggctcactgcaacctccgcctcccaggttcaagtgattctcctgcctcaacctcccgagtagctgggattacaggcctgtgccaccatgcccagctaattttttgtatttttagtagagacggggttgcaccttgttgggccagatggtcttgatctcttgaccttgtgatccacccgcctcagccttccaaagtgctgggattacaggcatgagccactgcgcctggcctacttatttgttgtttaaatttattttttttctgtcaaggtgttctttatttcagagagagggcaggacagggggctcagtctttcttggcatcagctttcctcatgatggctgggacattgctcagctcctcctgcctcctcttagtgcggatgtgcgtccccactcttttcttgatgaacttgagggcccgtttgtccttggagaccttgagtaacaccatggcgtgccgctcatacggggcgaaaccacacacctctcggatcatgtcccacatgaatttggtgtttggtcaggcgcccgcggcggcagctgtgcctgggcttgctcatgttcttggtcatcttgtggcccttgtcaaggcacacggccatagtgggtagcacagagccatggctgctgctctccaatggcagctgtggcagaagggctggtgccacgcggggatctactttttttttttttttttttttttttttgagtcacgctctgtcacccaggctggagtgcaatggtgcgatttcagctcactgcaacctctgcctcccggcttcaagtgattcacctgcctcagccttctgagtagctggggttacaggcgcctgcccccacacccggctactttttgtatttttggtagagacagggtttcaccatcgtggccaggctggtctcaaactcctgacctcaggtgatccacccgccttggcctcccaaagtgttgggattacaggcatgggccaccacgcccagcaggggatctgcttttaaagggctcactcatagggctgttggcaggatgcctcagtgcctcaccacatgggcctctcagtagggttgcttgtgtgtccttgtatcacggcaactggcttcccccacttggatcttgcaagtgagctgagagaacaaagtagaaaccataacctttggccaggcatggtggctcacgcctgtagtcccagcacttttggaggctgaggcagttggatcacctgaagtcaggagttcaagaccagcctggccaacatggtaaaaccccatctctactaaaaaatacaaaaaaaaaaaaattagccgggtgtggtggtgggcacctgtaatcctagctactcaggaggctgaggcaggagaatcacttgaaccagagaggcagaggttgcagtgagccgagatcacgccactgcactccagcttgggcaacaagagtgaaactctgtctcaacaacaacaacaaaaaaacgtgtaaccttttttatgacccagcctcagaagttgtacaccatcatttctgcaatatactagtgcttacacaggtcagccttactcattgtgggagaggactacataagggtgtgaatactaggaagtggggatcattgaggacatcttggaaactagcttccacagagtaaggtcaggatttgcaggaaagaggaatctcaggtttggggtatgttaaatttggggttcctattttatactctggtgatattaagaggcaattagatgtaccagtctagaatttagaggagttatcagcaggtacagggtagtttaaacaactggactaagaaaacctggggagtcaatgtaggtagaggataggtctacggcctgtaccctgggtatctccaatatttaaaagtcaggacaggaaggaagattgggacggattagccattgacgtagaagaaccaagaggtgtcccaaaagccaagtggagagagtttcaagaagagagagtgagcagttgtatcagaagctactgatagtccagtaaaatgaggagtgagaattgaccattgaaattagcaacaaagagattcctggagactttgaaaggaacaattttgatactgttgaggatgaaaatcggatcaaagagcaaaaaaggaagtggagacattacctataggtgacttgggagtttcactgtaagggagagctgagaaatggagtgggatctgaaggagaaagtggtgagatggtgggtttggtggtgagagcaagtgaagttctgttgcttctcttttcttagtggaaattgaaagcaaggacattagctaagtgaagaaataggagggggttttgggagcctaaggagagaggagaaggtctaagtcaccttagagagtgggagagtgaactgattagagaaatgaagtggaattgccaggcagtcctaaaggagcttcaggaaagaagtaggtacagagagttgaatggaaccagggtgtgggttttgctggatttgtaaatgaaagacgagaggaacagggagttgtggttatgtgcaagagaataattacagtggaccatgggatttcaggagggaagtgaggacgtgatagtgtcagcagtgtcaaagaattggtggatttcgggtactaaatagtgaacttggaaaataagggtaagtagttgaagactcagacacttgaagttgaattttggaagatttgcagttattggcagtgacaggatctaggtatgagtatgaaaatgggtagctgaggtgagatggcaaaatcaaaagattatcatgagtcgggaggtcagtattcattattgaaatcaccagttatgatggggtgattagagtgaggcaaggagccggtgcagagggagaggtgtgaggagaagcaccatggcaagaggttagtggcatacacgttggaattagctgaaatctgtttcctcggttgcattgggcaaagtcacttctcatcagtgagcctcaacatcttctcagtaaaacagggataattaccgccaccctcaaagagtcattgtggggatgaaatgagatgatggttgtgaagtacagtgatctgtacacagctaatgttcagtatttactgttgactgttttcttactgtttcttttattaaaagaattgatatgtgtgtagaagtgcttaatgcctgacccgtagcatgtactatatgaatattagttattataacttttattatccctaagcaaagggcttgtgcagactggagccaccgatttcactgtgtctggccccagctgatgcctctgcttctcccctccccttagagcttgggaaagtcgaggtgacggtgtttgaccctgactccctggaccctgatcgctgtgagagctgctatggtgctgaggcagaagatatcaagtgagctgggggggagcgggagcagggttcccatcaggcgccatctgtcagtcagcctcagcctcagtcagactgtggcaggtggggaggtcagaccaagaatctagagtgggcggggtatgtgcctctgtcattgatcctggtgcaagcgactgaggctttgtaaccaggccctatctgggagctgcagacctagagatgaagctgaagtggtctctgctcttccacctagagaaatggttcagaggtggtctctggagtccagttacctgggttctacccctgtttccttgggccaagccatgtaacctctctatgtgaagagggatgataataacatcttctcgtaagagtcacatatggattagctgtgtactgtgtgtaaagcactgaggtggaaggcccagcccagattattagaccctcagtatctgataactgctgctgtttcccagaccctgacttctgcaagactgattcagcaggtctggagtggggcctgggaatgtgtacttaaatttttttttattgtgggaaaatatgtgacataaaatttaccattttaactatttttaagtgtgcaactcagtggcattaggtatcttcacagtgtcatgcagtcaccactctctgtcctaaaacttgtcatcgcctcaaacagaatgggaatatgtatttttcacagtcctagtctgggcacaatggcttacacctgtaatccgtagcactttgggaggccgaggtaggtgaatcacttgagctcaggagtttgagaccagcctgggcaacatagcaagaccctatctctaaaaaaattttaaaaattaaaaaaagaaaacagtccttctgccactgaggaaacacatttggagaatgtttggtggtcagggatgaggctagcagagccttcattagcaggcagagctgctcgggctctatttccccagatgccagcactggacttatgcctctttaacactctcaccgtcactccctgccctacaggtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtatcaggagggatcaagacaagatagggccagctgggctgggcaagctccactgggaaccgagggcccagtcaggccctgagtaggcaaaaggaggacacagccagtgaatgagagagaatgttccttacaggtggccggaaacttccactttgcccctgggaagagcttccagcagtcccatgtgcacggtgagtgatctgcactagctggggagatttagatgctggccaccttcttggtgagcttgagtggtcctcttctgcctgctgctcatttgtcttgggcaaccatttggccagagcaggccttcatctcagggcagcagtttggcacagtggctaagagcacaggccgaggagccagactgcctgcattcagataccagtttcagaccttactggctgtgtgactttgagaaggtttcttaatctttttgactcctgttttctactttataaaatgttgatgagggcacttatctcacagggtgtgtgtgcaggttaaagatgatagcacggagcctggcttgtggtaggtacttgttgaaatggtagccccccgtgtccgatgatgacctgtgcatgaggctttgggagaagcagagctaggttggagcacaggttctgccacacctgggctatgtcatatttgggccctatttagttgcttcttctgtaaaatggggatgatgataatagtacccactcacagggctgttggggtgaacaaatgagatttattctcattcatttgttcattcatgcattcacaaaatatttagtaatcacctactagtctagttgctaagggtacagtagtgaacaatctgtgccctcagaacattctagtaaagaaatagacaataagtatataaaatataaatagtccccaattaacaatggttcagcttgcaatttttaacttcatgatgggtattacatgcatttttcacttaacgatattttctttttcttttttgagacagagtctcactctgtcgcccaggctggagtgcagtggcatgatcttgactcactgcaacctccacctcctggattcaagtgattctcctacctcagcctcttgagtagctgggtgtacaggtgcgtgccaccacgcccagctaagttttgtatttttagtagagatggggtttcattatgttggccaggctggtcttgaactcctgacctcaagtgatctgcccgcctcggcctcccaaagtgctaggattacaggcatgagccaccgcacctggccgacttacaatattttcaacttgcaatgggtttattgggacgtaaccccagtgtaggtcagggagcatctgtatatggtatatcagatgctgttaagtcatatggaccaaaacaaggcaggataaagatggtaatggggaggggctagggtagggcagtgagggtcctattttaaatatggaggtcagggaaaaactctttgatgaggtaatattttagcaaagacctgaagacagtgagggagccagccatgtggatgtctggggaggaagtgttacaagcagagagaacagcaaatgcaaattcctaaggctagaatgtgcttggcaagttcaagatacagtaagaaggttagggtggctggagcagaggagcatgcttagaaatgaagtgagagaggccgggtgcagtagctcatacctgtaatcccagcactttgggaggccgaggcgggtggatcacctgaggtcaggagttcaagaccagcctggccaacatggtgaaaccctgtctctaccaaaaatacaaaaattagctgggtgtggtggcacacgcctgtaatcccagctactcgggaggctgaggcacgagaatctcttgaacctgggaggtggaggttgcagtgagctgaaattgcgccattgtactccagcctgggtaacagagtgagactccatttcaaaaaataataataaataaagagaggtcacagggccgtatcatgcagggcttgcaggggcattgtagggactcgggccgttactctgcatgagatgagaagccattgtagggccctgaagaaggtgaggcatgatctgacttaaaagctctccagctgctctgtggacaagactgggcaggggaaaggacagaatcagagaggcccattaggaggcagttgcagtgatcaatccaggcaaaagatggtggggcacggcccagagtggcagtggaagtggtgggaagtgactggcttctggatgtattttgaaggtagagctgagaagagttcctgatgggcatgagggataaaggaaaaaggagtcaaggatgcctccaaagttttgtacctgagtagtaagaaggatggagttgcctgtaatcctagcactttgggaggccaaggcaggtggattgcctgagctgaggagtttgagaccagcctgggcaacatgatgaaaccttgtctctactaaaaaatgcaaaaaatcagccgggcgtagcggcgtgcgcctgtagtcccagctactcgggaggctgaggtaggagaattgcttgaacccaggaggcggaggttgcagggagccgagattgtgccatttcactccagcctgagcgacagagtgagattccatctccattaaaaaaaaaaaaaaggatagagttgccatttagcaagatgagggagactcagggcaggtttagatgttcggaaatgggatcgtacagctggtattcggcttttgacgtgttcagaccaatagcatctgggtgtccttctagacacccaaggtgtcaagtaagttttccattcaagcctggagttcagggagaggacttgcctggagatgcagatgttggcatcatcagcatgtgtatagagctgtgggactggatgaaatcaccctggaggtgagggcagatggagaagaagggaagctcaaagggctgggtgccaggcctcccacattagaggccaagggtgtcagggggaattggtaggggagactggaggaggagtgtaagctgggaatgtggcatcctgccagccacggacgggtgtttcaaataccacatcagatgcttctggatgtcaagcgggaattgaccatggcatgtacatgcaacagtcacttatagccttgactgagtcatttaagggtgtgacaggaccaccctagagtgggttcgggagggaatgggggaggagttggagccagtattgacagctctatagtggaaattgcctaggggaggagagagcatgagctgaagctagagggaaatgtggagtcgagggaggcttttctaaggagggtgatgtagcagaatgttaatatgctgttggaaattatcgactaaagagcataagtgatgctccagagacgagacagtgaccggagtgaagtcctggagaaggagaaagaagacagaatctagtgccttacatatgtggaaagtccaaacttagcaccaggaggaagggcaggctctgtaggtacaggtagggtggtagctggtgtggcagaagtacatggagagtctcttctgagtcttcccatcttctccgtgttgtaggaaggaaggtcctcagttgagaatgaggagagagggaaggaggtgttggagatttgaaagaagaaaagatgtgactggtcacttgggggtggaagagtgcgtggactggggagattgagtaggattgatgcagccctagggcctccctggagtccgcggctgtgaatgcaaagagagcggtcagcatggttgtctgtgtgggaatggactcagtcaacagaacattgcaattgcatggggtttggtgttgccaggtgcctgcaaaggtgagggagtcaaatatgtaaagaactcatcttgattctggaccacagcatatgagctaggaaaggaggaaagacaggatgtggggaagccagtgagggggcaggaggaaaaagggactacaagtcctgagtgtagtgtcaacaagttattggaattggggaactggaggaaattagaaagctggtggagcatgagttgcttgaaattgaagtcacagaaggggctttgttaatgacaaagtttagggaatggccaacagagcaagtggcttgggtaggcagagcacaagatcagggaggaaaggatgtccaggaactgggaggcccgggtactggaaggatcatctacgtggatatggaaatcactagaacgtgtgacagaggtagtacaggagagagtgacaggcagttgcccaagctgttgaaaaatggcatgggaaaactgttctggaggttccatatcgatatctaggtgactgaaacaagcagggctgctttgccctgagcttcaaagctggggattttttttttttttttttttttttttttttttttttttttttgaggctggagtgccatggcacaatcttggctcactgcagccttgacctcctggactcgagatcctcccacctcagcctctcaaggagctgagaccacaggcacatgccaccatgcctggctaattttttttttttttttttttgcagagacagggtcttgccatgttgcccaggctcctgggctcaagtgatcctcccgcttggccccccaaaatgttgggattacagatgtgagccattgtgcatttttaaggcagataaagggaaagtgatctggaagtggcagtaaggagcaagaaagacttctctttaggccagggaagaggttgtgtatggagagaagatagtcgcacgttgaggggatgccagggagttagtgcctgaaaggaagagccaggctgaagcaagaaagtgaagaggaacccaggggttgaaggcagggttggggaaggtgggagttggtgtcacagtaaaggatggacagagctgcacagtgacagagcccagggtatgaagatggcctctcaaaatggttgaagtgaacaggaagaaagggccccctggagggtagctctgctggtcttcagggcaatctgtgggggtggggctgtgttggggaggggccagtgtgggggctggaggaccctgcagagctctgggaccccctcttcactctggaggaagctgggagaaaagggtcttgctgggagggcaggaagatgatcagtgtcaagctgttggcacaaggtctggcgggcactcagtagacacacagccagagtggcagcctcttggcctgggactgttagacttgtggatccccgggccgggggtgctctgtatttggaaggatgtataaatgcaaaggtacagttgcccaaggccagagatctggctgaattgaggcctgggagtgagtttctaacatccttgttgattggggctggggtgggtaataatctcttacagtgtaaagtttacaagtatttttccatcttagatcccacgtgatccttaggacagccctttgcaaaggagaacactgaggcccagaaagggcaactgatttgcccaaggccacacagtcaggaacttggctctttgagctctaggcctcttgtccttctaggccactattttgctcctctctggccagattagttcactctcgaggaggggcccagaaggaggcttgttagctggggccagactgtgttgctgaggctgaatgttccagtcttccctcctgcaacatatcttgctctcatagttctcattgtgaagctctgaatctttcttctctctcctccctcccccatgctgcagtacatgctgtggagagtaagtggccctgcccccatggaggccaaacccctacttctggggcagcctgccctactagaatggcggggaggttggatggggctgtgattgggtctcctctgacctggctgctgggtgactgtaaaaggtctgggatgtatctttgaagtatggttccttgcagcaggagggattgaggctagagggcaggaataaattgttctggaacagttggtacagggtccccatgggatttcttctggggagctttgagggtggaggcagggaaagtgtggatggcattctcagatcccacctcactttgaggttcagtgatttgccatcagctctagttagtgagagcccatagtcggtgggttttgtttctggagatgcaggcagggccatggtggtagtcaaggcatagagttccctgtggacgtcagggaggaaccagggtctgttctaaagactcctgaggagggcgtgaactctcacacaggcccaaggcttgccctttctggctgtccttaagcaggaccaggaggtgccaggctggagaaggaatgaggggcagagaagacaggtggtttgcagtccagggggaggaaggaggaggccagtgctgctcctactaatgacgccttctcccttgccttctcccttctctcctagtccatgacttgcagagctttggccttgacaacgtacgtaccagatggaaaccatggagggcaggtgggggtgggaggcttggttgctgccttcatttccttgtaggaacatcctgggatggggtagtgcatatggaaaaatacaccacgttctgaatggggatccagcctgagggttaagcgagagtgacttttgaactgaactctgagcaggctaggggcaagattggggttggataagagcatcctagacagacagagcctcagcgcaaggtcagacgggagcatggcccttctaaggaactgcggggcaggtgtggatgggtgaggctggagaagtcggcagggaccagaccacaccggactcagaggccacgctgaggaatcacatctttctcatgagaacagtggaaagctgttggccttctttaagcaggatcacgacataatcagatttgcattttaggaaagatccttctagtgtctgaggctgatacacaagggagcaggaagggagtgtatctgggggttcacagcctccagcctaggcctccaggcaaagccagcacctgctactctgtgtgcctaacgtacaagtgaagctggtattttaagaaatctggaacctggccaggcatggtggctcatgcttgtaatcccagctactcaggaggctgaggcaagagaatcgcttgaataaggcgaggctgcagtgagccaagatcatgccactgctctccagcctgggcaacagagtgagaccttgtctcaaaaaaaaaaaaaaaaaagaaaaatctggaaccccaggagtttgcaggctgtggaaggaggagtttctaggcagggaatgggggattcttatctcggggaggttgtccccttaggaccatagcctccccttcctcccacatctccgcagacggacccaggtgtccctgtctgctactgtcatcagagctttggatgagctctggatggtgttgtttacagatcaacatgacccactacatccagcacctgtcatttggggaggactatccaggcattgtgaaccccctggaccacaccaatgtcactgcgccccaaggtaccagcccgggaggcagcccccagccgcagaaggccggccgggcacccatacccagtgctttgttttcccctcagcctccatgatgttccagtactttgtgaaggtggtgcccactgtgtacatgaaggtggacggagaggtgagtcagggagctccctaccagagtctcctgcgcggtgccaagcactggagttcctgcattttgttccgtcagcctggggagtgaaagctgcctcgtcctcacatggcgaataaaagactgaggcacagagagggtgggggatttgccctcccaggcagagtgcaggcctggggctgttagatttaaagcgcctgctctttctgctgccctcaccgcttctatccgttcctccggtgcccaccgtctgcctgcctcactgttctctgtggtctgcctgggctgggggttaggcaaggcaagtctctgtgtacccgctcccaaggctgccctggcctgtggagcagcatctcagcagagtggcaggatgcgaggggctgagggcagaggaagtcaggtcagccttggtgcgtctttggagagctgcttctcagcctggacccccgtgagaacacccaccaaatgctgccaggataggtaaactgtaaagacttggcacctggaggggaaggctgaggccaagactaggagagggggtctggcgggccaggccttgcagtgcaggccactagcacggtgctgtgttctctccttacacggccaaggctcaacaggaaaggggaaggagcaggggtggggctgatggtggctggagccaggtcctagccctagccctggcccaggctcccctcccaccccaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtgaggatgggggcaaagcggcctctgggggcctgggcctgagggaggaggatgcctgctgagcccaccctctccttctaccaggtccttcacccacttcctgacaggtgtgtgcgccatcattgggggcatgttcacaggtaagaggcccagggcgtctgtgagctgtggggtggggagggtaaagcctgggtgccccaggtttggttgggggtgaaggggcagatgctggcctggccagttaagtgacaaggctctcagcgtcaaaagccaaggcccccactgggccagtgccagcccttgtctctctcccagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagtactcactggtctccgtgtgatccttgccatggccagagcctcatcctggccactcactgaaggcaattgtgactgacagatcggggcccagagccctcgggagccccacatgggcatcccctagttaaccggggtttattcaaaccagattcatgtccagcccacagccctgtcctgggtccctcctccactgtggtcctcaggcctctcgggttcagccccagggctcagatggaccttttcagcgtgagcttcctggagccaccatggcccccaggctcatgagtgatcaaccccaggccactaattcagggccctgagtgcatattggggcttgccacttcttcattgatgggtaaagctggggccgctctccgccaccctgggctcaatacacctgatcctgtcacactcactgatcccactctgtgccaaaccccacgctggctctcactgcagagaggaatccctccaggtcctctgcagtctagatggaagcaaaactgaacactgaggtgcgaaagtagcagtcagtggccattctggagcagggccagcaccagacccctggcttggagcctaatcagggtttcccattagaactctggatccatgtggagaaccagggcccagcaacctcaccagtccacagcctagggaaccaggggtacctaaacagccagtcagtttatcagatcatgtctcgaatgttgatgcaagactgtggcaggggaaaagcgagagagaggggaaaggaagcgaagtcaggtagtgacagcagaacttttagctctgatggaagcctctctcagggatggtgaggaatggacaggttaatggagtccgtcaggtccttagctgtcctggaggggtggaagccagaaacagattaggtgagagggacctgccaccagcaggagcaggagcagtggtggagtgggtgtgataactcagctgccggggcccttttcttccctgtggtggggatgggggcagccttccatccctgtgcattcttcaagtccccagcacctgaggtcacccaagaacatctctgttctttgccacctggtgccggccttgtatagcacgtgatcacaggtcagtggctgtgataggtttattcagaggaagcactagactctggggtagctcacatgggtaagaaagacttccaggagcaggcattgaagggttggcaccctgggtgagtgtccaaggtcagcgagagtcacttgtggaggggacggaagatgacctggctgatctggccagggatggtgtagaagaccaggaggaggaagacggtgagcagcaccagtagcagcagcaccagggtgcgccagtaccggcgccagatgaagaagacaaaggtcttcagcgggttcacaaaccagttgaaggaagttttggggcggctgttgaggagaagagtggtgtcaggatgaggaggaagccccttgaccacccccacctccccatcggcccaggctgtggccccagccccggtgcctgactcacctgggtttctccagaggctctggctgcttccgccccttccccactggccgtttctcggcctcctccacagtcagcagctcaaactctgcctccaccttgccctaaaaaagacattcctgcatcactgggagcagggggcgggctcaggccccagctcagcctggcctctgcccacgggcacccaccgtgaggatgtacacattgccacccatgtctgtgaactccaggtcttctggccggcccttcctcctcctctgctttcgcttcttcttgccagcctgagcctcctgcgcctcccgctccacgtcctctgcctccttcagcttcactaccggccaccagcccctcaggcggcggcagcgaaacagattgcacctcggcccggccccattgcgggccagctgcacagagcagagctcggggccccgggccccacgcaccatgtctggtagctgcaactccagggatcctgcaagtccagagcacaccagattaggcatgggatcaaagtctcattgtgccaggggtgaggaggcaacacaccaaggttgtaaattggggcattgaaagttgttgcagtgtgcggtcaggccacagctatagaccacccagaccacagcccagcggtccacccattgctacttcccagtggaagagggccaagggtcgggatcagagtgccaaggaccaaaggctgtggagtcggtgtcagggtgacaagctagggtcaaatcagagttgaatcagagactctgggtgggaatggaggttactgtggtctaggcctaattaactcagtaattaggccagaaagcaaaggtttcacacctcgggtccaaaatcccaagattcaaggttgggtcagagtagggaactgggggacggaagtgagggctggaggcaggggcggaggtgagggctggaggcaggggctgagggtggggaaggctaagcattgtaataccaaggaagtcattggcagagatgcggtcatagtcccagacctgcaggaccagcactgcaggctgccggaactccgcctcctccagggcaaagggtccagacctgcgccagacgctcacctcccgctccgtgggcaggtagtcaaagcggaacacaaagcgccaattgaagttcccctccccagtcagggagttgaagtgaacgtctgtctcctgcttgtcatgctccaaccccttcacccagctggggccggggtgggtgagcgtcagggctggagctacatggagaacccactcctcaccccgctctcagcaccacggagggcctggggtcggggctctggactcagcccgagggcccacacccatttgcaatccccctagtgcaccgccgttgccccgcccggccagcagcctacctcttcacatagatgtcactcgacatctctccggtgagtggattctcgtcatccagaaccacatcctccgtgttccagatgacaactctgagctcatagctggggggcacattagggggtggcttcagactctcgagtggggccctaaaaggggctgcaggaagcaggagggacctgggccggggccactgacattcactggacacctgtgtgcccagcaggggaatccaatgcctgtggtcccatgaagggaagccccaggtgtcactgaccaccctggccacagcagatggccccaggaatggtctgtggggccagcgaggttctccttcccgtgaatttagaatcagggcgctgcactgttgcatggtgtggcatcagatgcaaagctggagctaccacaagccagagtttggggatgtagaaaagtgagtgaacagaaagccagtctgcagggagaagagggaggatgagagatgggggacaggagcatacagcgcctgagggacaggagggctgcgacactctggaccctacccgcatatagccctgtctttgggggccatggggttgcctggatagctgttttctccagcccagcatcaatttcccctcatttgttgacagcaccgtgattttctgctggtgacccacccccaccccaaccacccctccccaccaccactgtcaatctatggaattctggtggggcaggcccctccctccctggctggacggggtcggggagacatcactggactggccaattcgagtattacagccccctaaccacaatgattggttcttcagggcacagcatttgacccaagctggtcggctgagtcagccctgaggcttttgctgtaactgggaaagaggtgtttgtttctgctcaagtggcctggctgagatgtaagcctcgcactgttagatgccactttgcccccagccctgcagagggctccctgagagcgacaccaaggaaagcagagcccagaggcagaaagtgacaggctgctgatatccgagcatctgcattcagccctgtgtgaagtggctgtgacccacacacaactccactcagatgagcttaggtgggaagggggcttaccaaaaggtacttggactcaatttacaagagacactcaacttgcaatgcttttgaataacagggaatttaatgacacctaactgaaaagcctgtgatgagcaacctctgcctgcttcactggggacccgggttttcagaggagccttgtacaggtagaccaggatgtgcacccgccttgggaggaggcgacagaactctcacctgattggctgccgaggcttgatgtcaactgggggtggagcaggcacatcttgaggaaagatgtcaatccacatgtgaagagatccctggggggacaggaccaggctggagggtcttgccaggctcccaaccttccctgacagccctatggccacaggctgtgccttgtccccaagtggagaaaagagctagggtcaaaatgacagggtcgggtagatcctgggggatgaggatgaaggtggagtctgaagtgtgggttccaggatcaaggttagattaggggttcaaggatgaggtccaggctgggcgcggtggctcacgcctgtaatcccagcactttgggagtccatggagggtagatcacttgagctcaggagtttgagaccagcctgggcaatatgacggaaccctgtctctacaaaaaatataagaactagccgagtgtggtggcagacgcctgtaatcccagctactcccgaggatgaggtgggaggatcacttgagcctgggaggtggaggctgcagtaagccgagatcatgcacctgcactccagcttgggcaacagagtgagaccccatgtcaaaaaggaaaaaaaaaaaaaatgaggttccagaaggggaagttgagattaaaagtaatatctggtgttccaaggtccagatcttagggatctggggggaggtcaggttaggaaccccacatctgagtcttggggcccgggggtggggatcctgtaggactagggtcagggtgaaggtgtggtccaggatggaggtccaagatgagcagggacacagggaccagcaacaggagctgcagtcaggagctgcaggtggcacccaggtggacatcttggggaaaggctgtcctgggggcccagggtccaggatcaggtgggtgtcctgggattctaagagtcttgtgattctgggcctgggtgctgagccctcccacacctgtagcagccctgggctgtggggatggtagagaggcctggtttctacatgctcgggtaccagctggatcccaaaacccggcatttcctgccagcgccgcagcacaagcaatgcctgggcctcttcagggtccccgctcgccactgtggggctgctgctgcctgaagcaagaggtgtgtgagcttagggctccacacagtttccatctctcctcccgccctccccccccccccgcccccccaacagaagctctaagctggggaagccactgtgttggataaagccctgtggactaggagagcagctctgtaatgcacaaaaagtgggagacgctgctataactttgcccagtgaaaagccagcagtcagtgggacagtgggattggaggtactgccacctttgcctagaccctatttagagaataagccaccagagcaggcacactggctcatgcctgtaatccgagcacttttggaggccaagatgagaggattgcttgagtccaggagtttgagaccagtctgagcaacatggcgaaacctcatctctaccaaaaaaaaaaaaaaaaaaaaaaagaaagaaacttaggtgggcgtgatggtacgtgcctgtaatcccagctactcagggggctgagatgggaggatcacttgagcctgggaggtccaggctccagtgagctgagatggcaccactgcactccagcctgggtgacagagcaagaccctgtctcaaaaaaaataaataaataaaaaataagcctccagccatttaattctgcagccacattctgttatatggggcgctctatgggacctctgtgttccgggaacttgattagttatgggtccactttggctctttgggggaatctcacactcaccaataaagactgttttctccctaatacccaagaacctcgtccttactcaaccaaattcacatctacttgctgaagaaatgggttattttggggagcacacaagactgggccccctgtaccttgttctaccgacatcttgcttgaacagaaaggggctgatacctgggggcagggtctccggtggtgtcaggaagactttgctgcccaccttgacagcaccggctcggtattcaggggcagggaggccacagcgttggcacagccccgccaggatctgcgaaggccagaatgcatcacgccaggcattgtaaccatctctacaggcagaaaaagaagatgcgtcagctggggctggtgtagggacacagctgggcctggggcagtgatgacgtcatgaagacatgaggtctaggttcaaaactcccaacgggagacaggttagtcctcatttatgataacaatgaatgaaaaaaatgtagtccaggtgcttccattaagaagatactgatcttattacctctgttttgcagatgagaaaacagacttgaagaggttaagagggcctggcatggtggctcacacctgtaatcccagcactttgggaggcagaggtgggtggatcacttgaggtcaggggttcaagaccagcctggacaacatggtgaaaccctgtctctactaaaaatataaaaattagctggacatgggggcccacgcctgtaatcccagctactggggaggctgaggcaggagaatcgcttgaacccaggaggtggaggttgcagtcagccgagatcgtgccactgcactccaacctgggagacagagcgaaaatataaaaattagctggacatgggggcccacgcctgtaatcccagctactggggaggctgaggcaggagaatcgcttgaacccaggaggtggaggttgcagtcagccgagatcgtgccactgcactccaacctgggagacagagcgagactgtttcataaaaaaagaaagcggtcaagtgacattcgttacaggatcccgactcccaagcccaagtcttgaccactgagctatgtcttggttggcagtggcggtgggtgggagggtccccttccatgaaatcataggatctggagacacaaaagggaatgtgagcttgaatgtgtttggccagaaactcagaatggctcctgtgggccctgctggacccacacttcatactgggaggccagcccacagtttgctctgtggtggctatagaatcggttttccagatcaatgtgggtctccccgatgaggtcgtcagaacccacgaggtcatgatcaaatacggcgaccgtcagctccgtctcagctgggagagagatgcttagctccaggatcctggcaaggagggagagggactgaggtcacttccatgctccaggaggtggtctggggaggaggcgggtgtgtcagcatcccctgtccattcccttgccattcctaggccagctgccacaaggccacagggctggatgctcctgcagctaccccgtttccaccccacagggcccagcctcactctccaaagatggggttgagctgcttggggatgtagcgttccttggtgtcctgccgctcccggccagcgctcaccaccacgtaagggtctgctttgccattggggtctgcaggagccaggttggtagcctaggggaacagcatggagtggaactgagagaaatgtcattatgataacccaaggttacctttgtaggacctaatttcccattgggtgaaagcaggaagttatcaaggagagatctcccactgtgaggagctaatggagaggttggacaagatgacttttattttcaattagttatgaaatagttaagtcatacaaacaggtataacaaaaagtgtaatgaaacaaaatattttgaaagatgtataacggacttactattcaactcataactttctatatggtttgacttattttttaatttatgaatttttttaatagagatgagggtctcactatgttgcccaggctggtctcaaactcctgggccgggcgcagtggctcacacctgtaatcccagcactttggaaggccaaggcaggtggattatttgcagtgaggagtttgagaccagcctagccatcatggaaaaccccatctctactaaaaatacaaaacttagccaggcgtggtggcgcacacctgtagtcccagctactcaggaggctgaggcaggagaatggcgtgaacccgggaggcggagcttgcagtgagccgagattgcgccactgcactccagcctgggcgacagagcgagactccgtctcaaaaaaaaaaaaaaaagaaagaaagaaagaaagaaagaaattacatcctgtgtagttttttccccccactttttatagagacaggggtctcacactacattgccaaggctggtgttgaactcccggcctcaaatgattttcccacctcagcctcccaaagtcctgggattacacagtgtgagcctctgcacctccagccctgtgtagtttcttgactgaaagttgttgggtgattttttcaattgttgtttgcctaaagaggtctttcatttttttctctcttgaatgagtgtttcctaggacacacaattcaagggtgatagttatttttctcttagtgctttgaagatattattctatttttcttccagcacttttggttgctgtagagaagttgatgggctgactgtcattccattgtggtaatctgtactttctctatgatgatctttacatctttttaatttagagattgggtcttgttctgttgcccaggctggtctcgagaactcctggcatcaagcagtcctcccacctcagccttctgagtagctggggttacaggcatgagccactgtgccaccttgattatttttttggtatttatattttccatagcacttatgctttcttcttttttttttttttttttttccctgagacagagtctcgctctgttgcccaggttggaatgcaatggcatgatctcggctcactgcaacctctacctcccaggttcaagggattctcctgcctcagcctcccgagtagctgggattacaggcacatgccaccacacctggctaatttttgtattattagtagagaacggatttcaccatgctggccaggctggtctcaaactcctgacctcaggtgatccgcctggctcagcctcccaaagtgctgggattacaggcgtgagttatcacgcctggccacacttatgcctctctaacgcactgaaacatttacttattttgttaatgtttgtttctcctactagaatgcagtcttcataaaggcaaagctttttttctccttgtgattacatattaattttattctttgaaatctctttcttctcttgtcctgtccaaatcctacttagagatactcagtcaagccttaatttcctgtgctggctcggctcagtggttcatggctataatcctagtactttgggaggctaagacaggcaggagctcaggagttcgagaccagcttgggcaacatggtgaaatcctgtctctactaaaaaatagaaaaaattagctgggtgtggtggcatgcgcctgtagtcccagctacttgtgggggctgaggtgggaggatcgcttgagcctgggaggtcaaggctgcagggagccgtgatcatgccactgcaccccaccctgggcaacagagtgagaccctgtctcaaaaaaaaaaaaaacccgcgaatttactgcagagacagtaataaaggagtatggtagtggcataaacatagatcagtagaatagaactgagagtccagaaagaaatccacatatctatggtcaattgatcttcaacaagggtacctagaccattcaatgggaaaagaaccatctctccaacagatggagctgagacaactggacagtcacatacaaaagtatgaggtcagaccctcacctcacactagatacaaaaactaaccccaaatggatcacagacttaaacatgagagtcaaaactcaaactcacagcagaaaacaggcaaaagtcttcatgaccttggattttgcaaaggtttcttagctataaccaaaaagcacagtcaataaaagaaataaaaatagacttcatcaaaattaaaatctcttttgctttaaaggacactatcaatagagtgaaaagacaacgtagaaagtgagaaaatatttgcaagccatataaaaatctagtagccagaatatacaaagaactcctacaactcaacaacaaaacaacaatctaattttaaaacggacaaaggactttagacatgtctccaagatatacaaagttctaaaaaccacatgaagactgttcagtgtcattaggaaacaaatcaaaaccacaattagataccactttatacccactaagatgatcttaattttttctttttcttttttttttttttttgagtcagagactcgctctgtcacccaggctggagcgcagtggcgcggtctcggctcactgcaacctctgactccagggttcaagcgattctcctgcctcagcctcctgagtagctgagattacaggcgcctgccaccacgcccggctaattttttgtatttttagtagagactgggtttcaccatgttggccaggctggtctcgaactcctgacctcgtgatccgcccacctcagcctcccaaggtgctgggattacaagcatgagccactgcgcctggcctgacattcatttttttaaaaggacaataaaggctaggagcagtggctcatgcctgtaatccctgcactttaggaggcctaggcgggtggatcacctgaggtcaggagtttgagaccagcctggccaacatggcgaaaccctgtctctactaaaaatataaaaatcagccaggcgtggtggcgagcgcctgtaattccagctacttgggaggctggggcaggagaatcgcttgagcccaggaggaaagggttgcagtgagccaagatagcaccactacactccagcctgggtgacagagcgagactctgtctcaaaaaaaaaaaaaaaaaaaaagaaaatgtaagttatattctggcactcctttgctcagaaccttcctatggcttcccatgtaattcagaataaagtgaataacaaaacccaacatgatctgctttctctgcccatcactgctccatttcctctgaagccttaattcctaaaacctgttcatttatcctgcctgctacggccacaaggggccccttgttgtttgtcacacacgagtcatggttctacctgatggcctctgtaccagctgttctgcctggaatgctttctccctcaggtagccacctggataactccttggccccctcctagtgtgtatttaagagacagggtctctctctgtcacccaggctgaactgcagtggtggcatcacagctcactatagcctcaacctcccaagctcaaacaatcctcccatctcagccttcctagtagctgggactacaggtggaagccactgtgcccaactctagtatttgtttaaataacactttctcagccgggcatggtggctcattcctgtaatccagcattttgtagttcgagaccagcctgggcaacatagcaagacctcgtctctaccaaaaaaaaaaaaaaaaaaaaaaaaaagtcttattgaggtctatcaactccgaccatccatttgcaacccacccccagcactcccccatccctttatcctgacatattttctccacagcacttataattttctaacatataaataagatatataacttttttttgttttgagatggagtttcgctcttgtcgcccaggctggagtgcagtggtgtggtctcagctcactgcaacctctgcctcctgggttaaagcaattctccttcctcagcctcttgagtagctgggactacaggcatgtgccaccaggcctggctaatttttgtatttttagtagagacgggttttgtatgtttagtagagacaggagttcgggctgatctcgaactcctgacctcaggtgatctgccccctcctcagactcccaaagtgctgggattacaggcgtgagccaccatgcccagcccgtaagctatataatttacttattgattatggttattgttcatctcttttcactagaatgtaaagttcacgagggcactgattttcatctgttttactcactgctttttatcaccagtacccagaacactgcctagtacctcataaaaaatgcaagaaaggccgggcacggtggctcacacctctaatcccagcactttgggaggccaaggcgggcagatcacctgaggtcgggagtttgagaccagcctgaccaacatggagaaaccctgtctctactaaaaatacaaaattagctgggtgtggtggtgcatgcctgtaaaccccagcttgaggcaggagaatcgcttgaacccaggaggcggaggttgcagtgagccgaaattgcgccattgcactccagcctgggcaacaagagcgaaactccgtctcaaaaaaaaaaaaaaaagaaaaaaaaatgcaagaaatacctgtggaataaatgtttgtgagtgaaactggcctagaattatactttctcatgtcattcttctcaggttttgcatcaacattatgccaccctcatggaattaactggggtatttctttttatattctctgaaatggtttgtgtaagattaaaattgtttcatccataactggtggaaactgctgctgagaccatttggtctggagtttctgacacaatttcttttaatacttatagtactattcaggttttctggccaggtatggtggctcatggctgtaatcccagcactttgggaagccgaggtgggtggatcacttgagaccaggagttcaagaccagcctggccaacatggcaaaaccctgtctctactaaaaaatagaaaaatcagccaggcgtggatgcaggcacctgtaatcccagctactcaggtagctgaggcaggagaattgcttgaacctaggaggtggaggatgcagtaagccaagattgcaccactgcactccagcctgggcgacagagcaagactatctcaaaaataagtaagttttcttcctttttttctggcacactgcatcctcagtggctcaagcaatcctcccacctcagcctcctgagtagctgggacaacaagcaggaaccaccacgtccaggtaatttttattttgtttttattttttatttttttttttgagacagagtctagctctgtcgcccaggttggagtgcagtggcatgatctcagctcactgcaacttctgcctcccaggttcaagcaattctcgtgcctcagcctccctagtagctgggactacgcacatgccaccatgccctgctaatttctgtatttttagtagagcattggggtcttaccatggtggccaggctggtctcaaactcctgacctcaggtaatctgcccaccttggcctcccaaagtgctgggattacagaggtgagccactgcacctggcctaacttttaaatttttttgtagagatagggtctcagccgggcacagtggctcatgcccgtaatcccagcactttggggggccaaggggggggcgcggatcatgaggtcaagagttcaagaccagcctgaccaacatggagaaaccctgtctctactaaaaatacaaaaaattagctggatgtggtggcaggtgcctgtaatcccagccactcgggaggctgaggcaagagaattgcttgaacccaggaggcggaggttgcagtgagccgagactgtgccacagcactccagctggggcaacagagtgagactgtgtctaaagaagaaaaaaaaagtggacgttgtagtgaagggattgggaggagattcgtggatgtaatgaagatacagcttagactacacgctgtatctattttacaggggagagccaaaggataagacagctgggaggagctctcctggggttaaaacaaatatcaaacactaacctcagaaagtattcattggaaagagccaccatttgattagatttatttgtagaggattttatgctcccaggatactactgcaaatgacagagcaataagtagagcttaactgggtgtggtcagggaaaagaatgcaagagggccctaccagtaccactgtcatcctagggtgacagtggtatatccaaagctgcacctgccagagtagcaacatcagtgatctaacacaggggatgggaaatagactttgctaaaataatccagccagtcactaaacaaataaacaagcaaataacaagaaacctcagtacccagagttgctatcatatattatctaaatgctgtttccaacaaaaaattatgaggcctgcaaagaaatagaaaaattatttttccatccaccccccaaaaaatgcccgtgagagcaacacaatgttgaacttaacaggaaagtatgtatgtgtgtgtgtgtgtatgtatgtatgtatgtatgtatgtatgtatgtatctatctatatatatatatatatattttttttttttttttttttttttttgagacggagtcttgctctgtcgcccaggccggagtgcagtggcacaatctcggctcactacaagctccgcctcccgggttcaggccattctcccgcctcagcctcccgagtagctgggactacagtgcccaccagcatgcccagctaattttttgtatttttagtagagatggggtttcaccatgttagccaggatggtctcgatctcctgacctcatgatctgcctgcctcggcctcccaagtgctgggattacaggcgtgagccactgcgcccggccgactggaaagtatttcaaagtagccagtgtaaacatgttcacagaactgaaggaaagcttgattagagaagtaaaggaaggtatgatgataacgttgcatcaaatagagaatatcaataaagagatatacattttttttgttgtttttgagagaatctcactctgtcacccaggctcgagtgcagtggtgtgatctcagctcactgcaacttctgcctcccaggttcaagcaattctcctgcctcagcctcccaagtagctgggactactggcacatgccaccacacccagctaattttttgtattttttttagtagagacggggtttcaccgtgttagccaggatggtctcgtctcctgacctcatgatccacccgcctcagccccccaaagtgctgggattataggcatgagccaccacacccagccaagccatacatttttttaaaaagaaccaaatgaaaattctggagttgaaaagtacaataactaaaatttaaaattcactagagaggctcaatagtagatttgaacagaagaaagaattggcaaacttgaagctagatcaaaagcgattatgtaagctgaagaacagagagaaaagagaaaaaagaaaaatgaaatagagcctcaaacaaatgtggaacaccattaagtacaccaacacacgtataatgggagcattaggaggagacagagagctgggtgcagtggctcacgcctgtaatgaggcaggcggatcatttgaggtcaaaactttgagaccagcctggccaacatggtgaatgaaaccccatctctaaaattagccaggcatggtggtgtgtgcctatagtcccagctattccggaggctgaggtgggagaatcacttgaacccaggaggtggaggttgcagtgagctgagattgtgccattgcagtccagcctgggcaacaagagtaagactccatctcaaaacaacaacaaaaaaagaaggcaggctgggcacggtggctcacacctgtaatcccagcactttgggaggcccaggcgggcggatcaccggaggtcgggagtttgagaccagcctgaccaacatggagaaactctgtctctactaaaaatacaaaattagcaggatatggtggcacatgcctgcagtcccagctgcttgggaagctgaggcaggagaatcctttgaacctgggaggcagaggttgcagtgagccaagacagtgccattgcactccaacctgggcaacaagagcgaaactccgtctcaaaaaaaaaaaaaaaaaagagctagagagagagaaaagaagaaaaaagaaagtctgaatatccaatactatcattacttttgttgttgttgagacagaatcttgctcttgttgcccaggctggagtgcaatggcacaatcctggctcactgcaacccccacctcccaggttcaagcaattctcctgcctcagcctcccaagtagctgggattacaggtgcctgacaccacacccagctaatttttgtatttttaatagagacagggtttcaccatgttggccaggctggtcttggacccctggcctcagactcccaaagtgctgggattacaggcgaaagccactgtgcccagcctcattacttattctgttgccccaatttttcaagtcttaaccattaggagctccttcaggttggctcctgtgttcattctttcatcaagcccccatccttttttgagcacttccttactcctgccccacaagatgctccagatttgacttatattttcccagtcctagtcctggaatcaactccaaggagtccttaatccttttattaaataatggtttttagaaaccaaaatctgggcacctggtttgctcactgctactaggatgttgttgattctaggccttctcagcaaacggagatagcaaacatgaataacataatccacatatatatacacatatctatatttctgtatctttccatctgtgtatatttaaaaacatgagtttatacagatacttctgtttctgatctaataccacagcattcatttaatcccctttccttatctgtaacttctttctccaacagtaagaaacctggttctcattatctacaatatagtttacttattcatgtataccagtatacacataatatagtttcagaattgctaacacatacttctaactagatgacagcatttatgttcagctctctttatctttagtttagttggttttttgttttgtttttgttttttgtgacaagctctctccctgtcatccaagctggagtgcagtggcacaagcttggctcactgcaacctcctcctcccagcttcaaacaatgctcctgcctcagcctccaaaacagctgggactacaggcacgtgccaccatgcccagctaatttttgtatttttagtagagacggggttcaccctgttagccaggctggtctcaaactcctgaccctcaggcgatccacccaatttaggcaatccacctgcctcagcctcctgaagtgctggcattacaggcatgagccaccacacccagccacatccagctagttttttaatcttttgtagagatggagtctcactttgttgcccaggctggtcttgacctcctgggctaaagtgatcctcctgtcttggcctcccaaagtgctgggattacaggtgtgagccactgcaccaggcccatctagagttttatagagccctgtcaaattactgttttccagagttacttggttttgttcttcacttccttcagtgtggttatattgttcatttgtaatacagtgagggtcatttgttagtgtttgtattccatgttaggtttcctcaacactgtgattgcttttaattttctgtctattgtaggggcatgtgaaacactgctacagttctaagagtcagaggtatacaaaaagatctactttgagaagtgtcatttttgtcctcattctcgcaaccctgacccctttccccctttcgttccatccctttgccactcactttcttttttgttttttttttttggagacggagtctcgctccgtcacccaggctggagcgtggtggcgcaatcttggcttactgcaacctccgcctcctgggttcaagtgattctcctgcctcagcctcccgagtagctgggactacaagcatgagccactatgctcagctaatttttgtatttttagtagagatggggtttcaccatgttggttggccagaatggtctcgatctcttgacctcgtgatccacccgcctcggcctcccaaagtgctgggattacaggcgtgagccaccacaaccggctccgagatatctttaagaatacttcaaggccctgctgaactcagtatgaaaactgcaccaatggacaaagttggacaaaggtatttggtaacaagccttctgaagcctgagattcagccctgttctcatcctagaattatacgtgccattctacaggactagaactacaaacaggggtcaggagaccaactcccaattctggttctgccatgaacatgctttataaccctaggggatctcctaaatttgtggattcaatttctcacctgaaaaatgaagaacttgaactctgtgatcacgaggttcctcccaaagccttccttctgtaggttttgtgtacattaccttagctatagttggaggcgtgccagggctatggagactcacctttacaacatacactctgaccaggagcttgatgggccggttctgtgggatcccccgggagatctggggctcagagaacaacactgcctctgattcagggtaaatgaggaaggagccctgagttggggggagacagaaaaagctctggtaagataattgtcctcctgaatccccacctgggctccctggttccgctttccttccccaaatgtaccttgaacttgcccacaaggtgtccagatccttcctcttctccacctccatcctggcccccttgccctcggtacagaggaaacacattcagccagtcttcaaagtggttaaattcttccttcagggacctgttgtagatctaaaaggcaaggacttcagcaacagcccgatgtccagaatccaaaggagactttcctcttcccagtacccagtcaccttcagggtggcaactgctttttttggggacacagtgcctttgacttcagcctcaccctggtcttggatctccccaaccatagaaatgaggttgaccccatctggaaacagcaaaaatgccccagtcagaaatatctgggtgggtaggggatgggcagatggaaccagagcaaaaagcccaatctgttacctgaatctccaggatcatccatttcatcttcatcaaagttgtgctgaaattaaagagcagatccagagattcttccccatccccttcaaccccttagtctacccccttttccaggagagttgggaaaccttcactcaagttcccactgtgtatgccacttgcatttttaaagctccaatttatcatccagcctgccctgtctagggcagtcaccaccagccacacgtggctactgagcagtcaaaacgtggctagtctgaattgcaatgtgctgtaagtggccaggcttggtggctcatgcctggaatcccaacactttgggagactgaggtgactacttgaggccaggagttcgagatcaggctgaacaacacagtgagaacctgtctctatgaaataaatgctttttaatttttatttatttatttttgagacagactcttgctgtgtagcccaggttggagtgtattggtgtgaacatggctcactgtagcctcaacctccgaggctcaagtgatcctcccacctcaacctcttgagtcgctggggccaccggcgtgtaccaccatgcacagctacttgttttcatttttagtagagatggtgtctcaccatgttccccagactgttctcaaactcctggcttcgagtgatcctcccacctcagactcccaaagtgctgggattaccggcatgaaacaccacacccaggaaaaaaaaagtttgtaattagctgagtgtagtggtatgtacttatggtcctagctactggggaggctgaggtgggaagatcacttgaacccaggagtttgagaccagtctggataacagataaagaccccatctctaaaaataaaaagaaaagaaagaaaaagatgtgcgataagtataaaataaaaaccggatttttaaatacttagtacaaaaaacaagaatgtaaaatatctcagaaattttatgattacttgttgaagttttttttttttttttttttttttttgagagacagagtttcactctgtcacccaggctggagcacagtctcggctcactgtaacctccacctcccaggttcaagcgattctcctgcctcagcctccagaatagctgggattaacaggtgcccagcaccacgcccggctaatttttgtatttttagtagagacggggtttcgccatgttggccaggctggtctcgaactcctgacctcaagtgatctgcctgcctcagcctcccaaagtgctgggattacaggcatgagccactgtgcccagccttgaaatggtattttgaatatattactaaaattaatttcacctgtttcgttttacttttttttttttttttttttttgagagggagtctcgttctgtcgcccaggctggagtgcagtggcgcaatctcggctcactgcaaggtccgcctcccaggttcacaccattctcctgcctcagcctcctgagtaggtgggactacaggcacccgccaccatgccccgctaatattttttgtatttttagtagagacggggtttcaccatgttagccaggatggtctcaatctcctgacctcgtgatccacccgccttggcctcccaaagcgctgggattacaggcgtgagccaccgcgcctggccccttctactttaatgtggctactacaaaagttaaaattacgtatgtggctcgtgttatgtcttttggacaacacagctctagataatggagttaataatccccagcttctagaattgtgaagaaaagaggactataatgaagagctctgaaaaactgtagagctccaccttcaatgagatcattcttgttttttgtttgttttttgagacggagtctcactgtcacccaggctgttgtgcaatggcatgatctcagctcacaggagcctctgcctctgggttcaagtgattctcctgcgtcagcctcctgagtagctgggactacaggtgcgcgccgccatgcctagctaagatatcattctttttaccatttacaccccagccccctccctgggacccttctctgcccccacctgcccctggagctcctgcagcgacgcatagtacttggacccccagtcgagctcctctggatctgggatgtcttcctccagcccagggccttgatttaggaggcctcctagtgggagcttcttcagaggaggctgaggaagagcagactttgtccctctaacccagcaccatcccaagtactgccagccccttcaccatctatctcctctaccccatcaccttcaggagctgtctggatatacccgcttcagccaagaagggatccagggacttctgtcctgggagggggaaaatggcagcatgaggagagtgggtaagtagaagtcagattccacaccccatcggagggccctctggagccacgtccaccaggaatcagaggggcttctgtctggtgtccctgaaggagaaggttcctaaccttgaggtcccttgggcatcatatcccctgtctcctccatctctccttcctcctcaggaggatcctcatgaccccgaaatgtgaatcgcagcatgtgggggacaatgtgggaacccacaaggactgtgtggccaaaggcccggcgctcaatcaccaagatgctgagtggaggctgcaagtaaggctgctccggcaagtcctgggggtggaagagaggagctgtgtctttgaagacctggggaacagggaaaggtagccacagagacaggtaggaaaaaaaatacatctaaacctgcattctaagcccagctctgccatagcctcactgtgtaatctctggtaaaccattgccttctcatcctgtttcctagctaaaaaagggacacaggccgggcgcagtgtctcatgcctgtaatcccagcacttggagaggccaaggtgggcagatcacaagttcaggagttcgagaccagcctggccaacgtagtgaaaccccatatctactaaaaatacaaaaattagctgggcgtggtggtgagcacctgtaatctcagctactcgggagactgaggcaggagaatcgcttgaaaacagaaggtggaggttgcagtgagccaaggtcacaccactgtactgcagtctgggcaacaacagcaaaactccatctcaaaaaaaaaaaaaaaaaaaaagggacacaatcctggattcaaaagactgttgtaaatatcaaatgacataatagaaacataagtactttggagcctacaaagtgctgtcagaagctgggcatggtggctcatgcctgtaaccccagcactttgggaggctgaggcaggcagactgctcaaactcaggagttcgagaccagcctgggcaacatggcaagacaccatctgtaccaaaaatacaaaaaaatagccgggcatagtggtgcgcacctgtggtcccagctactcaggaggttgaggtgggaggatcacttgagcccagggggcggaggttacagtgagccaagatttgcactccagccttggtgacagagcaagagaccctgtctaaaatatatatgtgtatatacacacacacacacacaaatatattttttggctgggcatggtggctgacacctgtaatcccagcactttgggaggccaaggcaggcagatcacttgaggtcaggagtttgagaccagcctggccaagatgatgaaatcctgtctctactaaaaatacaaaaaaattagctgggtgtggtaacgggtggctgtaatcccagctacttgggaagctgaggcagaagaatagcttgaacctgggaggcacaggttgcagtgagccgagatcgcgccactgcagcctaggcagcagagtgagactctgtcttaaaatatatattatggtttattttattttatggttaaaggccatatatatatatatataaaatatatatatataaaatatatataaaatatatatatataaaatatatatataatatatatatataaaatatatatatataatatatatatataaaatatatatatataaaatatatatatatataaaatatatatatatataaaatatatatatggaattccatatctatcaatggatcctaagggaaacaattttactactgtattggtgggtttattttatgtatttgtagatatatacatatatacacatatatatgacaattttagcacaaaagagaggaaaaatagagctataccacagaaaagtttgtatattttactggaattaaattagtattaatctgaagtagactgtgaaacagtagtatgtatattgtaatccctagagcaactactaagtaaaaatcagcaaattaaaatagtacactaataaatatcaaaatataataaatatctatttaacacaaaagaaagcagtaaaagaggaataataagtccacaagacatagaaaacagacagcaaaatggcagatgtaaattcagccaataatatcaacagcatcaaatgtgatcatattaaataccaatcaaaagtcagagattgttaactgcattaaaaaaaagagatgcgactccatgctgtctaagagatactctagattcaaagacacataaaggatgaagtataggaaaaaaatatatcatgcaaatagtaaccacagagagctggagtagttataccaccagagaaaatagactttaatacaaaaaatattactagagacaaacagatactttataatggtaaacaggtcaattcatctagaagatataacaattataaacatatatgcacctaacaacagagcctcaaaatacaaaaactaaaaagttatagaattaaagagagagatacacaattcattagtaatagctggagatttcaataccctattctcaataatggatagacagaaaataatcaaagaggcttgttcaagaggtctgaataacagtaacacctagagagcaccacaagtccatgaattaatccaggaatcagcaaactacagcccatagacagagtctggcctgctgtcagtttttgtaaatattcatttacatattatctatggctgttttcatgctacgatggcagagttgagtagttgcaacagactggatggctctcaaagcctaaaatatttactatttggcccattatagagagtttgctgacccttggatcatctaagataaccaggtagaaagtcaccatccactgccctctttcactattctgccccccttttcccctagcccgtggcctcaccactgtcagatgcctgacaagctcagtgaaattggggctctcacggtagctggccaggacctcagactccacaccttgcccagccacctccagtacaacctggggctgctccacctcgagcagatgcacacgaccaagtcccctaagaccccagaacagcacctggggtcagaaaatgggagattcaggggcctgcaccagacaaatgggcacccggatgttggggaacaagggggctttgagtgcctggtgatacctcaacacggaactccctgagcactgggcacacgttgggtggaagggacaggcgtccagagtggggctcaaccaggggtgccagatcctggggctccacctcactgggcactgagggctgtaggagggaaacagtcagagggcgaagaggaatcaggccaaaggaggaaaagcctaggtgtggggaggggatatggagaggtactggtgaaatgtaaatgcacaggaaccaaccaaggctggattggtggaagggagggggtctcgggaagcagcttcgtgcaggaagggagcagggtgtctgaggcatgcaggatggcccaacaaggtgaacctagcacatgaatacttgcaatgttccttggggtcaagtggtccaatgaggtgacctcaggacaaacctgcagtctttattctctggggaaaagagacctggaggctggtcctgggacatatccatgttttatattccctagggctggatggcctgatggactaacaagttgggctcacagcctgtgctagccacgccagggcatgctgacctcaagtcggccactgtagtctagttcaatgagttgaaaggcggcaatgagctctccggctgcccagggtcccttcctcagggggaagaactgcaactctgggcgttggtatgggtcctccatcagctttacccttggggcggccagtgccctgcccaggaacacgggggggccctagggggagcagggcagtgaagacaaaggggaagaggctcaggagccagggaaggtgggcatcaagggggaaactcctggccaggaacccagggagggcccaggccacactcacaaacttattgtggtcaaatacattgatgatcactaatggaggctcctcctgcaggtgctccctcctcccatccacgatcaactgctcaaataccaggagttcatcccacagagggctcagcgtctgctccaggaccttgggggccatacagagaagcgggtagcagcagatatcaggagaaggctcccaacatgcatgccatgcgaacacccctgctctgaaggaatactttaagtaaatgctcatcacaagaagagtgagatgtgaggaagacgaaagcatcttcagttggtgttgcagccagcccctcacagccctgcctccccattgcaattggcccctcagagtccaggcctaaagtcaaccccagaaaatgactcctcgccgctaagacctccagttctacatcacctgctaagttagggccatctagtaccccatcctgataccctgctctgcaaacccagagtgcgaggagaggggccttggggaaaagctcagacccaccctaacttgtctcctgggtcccttccacccacatgtcatcccagccctcacccgtgtggtctgacactgggtagagatgaggactcgagcaaaggggtccgagaggccactgtcatctgcagccaacacaccccgggcctggtacaagtgagcccggagttggaagtagctaaagtctggggtgaggggcaaggaaggtgtcatgtttgcccaggggaaccactgaagtcccctgactgagccccacaccttgggcagagagccaggtgggccttatacctgccctgcccaccctctgcactcaccgtcccggtgtaggctggagggcagcccggctgagggctcgggcagcaaatccgggggcagctcagaggtgcaggccttggcttgcttgcccaggcccagccgcaggaagagctccagcttggcacagacctcaccaggggctgccccgggtgcctgtgtgtgaagaaggcatgtcagggccccgatgcctcttctcatgaccccagctagacctagcaatcctgcttccccagggcacacctctactgcacatcgccacaccatgccaaactcccagtccactccctacctgcccagccttaccctcttcctaccctccaccctacgccatgaccctcacactcttactccctatacctcttgccctaacactgccacttcccgtaccccactccccagacccctaactacactctgagctctgctctcccacctttgtcccctccaccccctacacgtttacattccccatccccaaccccaagggtcacggcttctccctcctagggacccttttcagttatcttttccagggacacctcatttagaaatctttggcccacaaaccagctacacttttttttttttttttttttttttttaagatggagtctccctctgttgccagtctggagtgcagtggcgtgatctctgctcactgcaaactctacctcctgtgttcaagagattctcctgcctcagcctccctagtcgctggaattacaggtatacaccaccacacctggctaatttttgtatttttagtagagacggggtttcaccatgttggccaggctgctctccaactcctgacctcaggtgatccgcgtgcctcagcctccccaagtgctgggattacaggcatgagccaccactcccggccagaccagccacacttgtaaggggtgagtcacactctctcgtttttggtaccctgcctatctgtcagggcctagtcagcaaaatggcccatgcagtcccagagctagggaagatttggggtttatctgatttcaaagctgccccaggcaaaggcacaatccctttctggtgttttggacaattggaaagtgttcaggggcccctagctgggaagcacaggcctctacccaaggcctatcctacccttgccctataagctccactccacttctcccggcccctcacccgtgggtcccctcaccgtgagcattagactctggatcttcccacagtctcggccccgttcctcctcaaccacagagaacagcacatcctgggcagggatccgggcccaggccacacggcgctgcccgctgagcatccagaccagcacatcggggaggggtggctggggctgcgggtggataactggtcacggaggtggatctggagccgacctctcctgctctcacagcttgaactgaacggaccaaatagccactccagcttctatctccccgagacagggtctcactctgtcgcccaggcatgagtgcagtgacactatcatggctcactgcagcttgaccacccaggttcaagcattcctcccacctcagcctctcaaggagctaggactacaggcacgtgtcaccatgcctggctaattttttactttttgtagagatggggtttggccacgttgcgcaggctggtctcgaactcctgggcttaagagatcctcctgccttggcctcccaaagtgctgggatcacaggcatgagctaccacacttggcttcttttttttaattgtggaaaaatacttataaaattgaccatcatcctaaccatttttaaatgtacggttcaggggcatgaaatatattcacaatgccaggcacggtggctcacgcctgtaatcccagcacttttggaggctgaggtgggcggatcatgaggtcaggagatcgagaccatcctggctaacatggtgaaaccccctctctactaaaaatacaaaaaattagcctggcgtggtggcggacgcctgtagtcccagctacttgggaggctgaggcaggagaatggcatgacccgggaggcggagcttgcagtgagccgagatcgctccactgcactccagactgggtgacagagaaagactccgtctcaaaaaaaaaaaaaggaaagaaaaaaaaaagaaatatattcacgttattatgcaaccatccccatcattcatccccagaacatttttcatcttgcagaacagaaactctgctcattaaaccatacctctccattcactgctctccatcccagcccctggcagccaccattcttctttctgtgtttggatttgactacaacaagccctccatatgagtggaatcatatagtgcgtgcccttgtgcctggcccagttcactaggcataatgtcctcaaggctcatgcacgtggtagctggtgccaaccttgtctcttcacctttccctcctccccagtcttatcttccccaatgtgcacagtgtgcacatgtggtgcccatcacatcagccaaatacctgggctggtgacactcttctccaacatccaatcacccattcctggcagtttcccccttctctccctttctccctgccccacttcaagaccatctgctttttttttctgttgccgaggctggaatgcagtggcacaatcatagcttactgcaggctcaacatcctgggcccaagtgatcctcccacctcagcctcctgagtctctggggactataggcacacaccaccatgccttgcgatgttttcatttttaaatttttttgtagagatagggtctcactatgttgtccaggctggtctcaaactactggacttaagcaatcctcccacctcagcctcccaaagtggtgggattacaggtgcgagccaccatgcccagccaaaagaccacccactcttggctagacaattgtgacaggctcctaagcagtcttcctgccttgagtcctcccttcctacccactctgccatggctggctggcttctccccatcctctgggtgtcagctgcaatgttgtctttgcagataagacttgcctgaccaccttacccaagcaggttctcctccaccccctcagcctctgtaacctctttcttaccaattcctatagatcataattatttttcatattcatttacagatgtatagtctgtcttcctaggacattagcctcaaaagggcaaggaatatggcaggggctgacccccagggcctaatacagagcctggcacacaggaggacttgaaatatcattgagaggccaggcgtggtggctgaggctgggcatagtggctcatgcctgtaatctcagcactttgggaggctgaggcgggtggatcacctgagatcaggagtttgagaccagcctggccaacatggtgaaccccatctttactaaaaatacagaagagtaggcaggcaaggtggcacgcgcctgtaatcccagctacttgggaggctgaggcaggggaatcacttgaactcaggaggcgaaagttgtagtgagttgagatcacaccattgcattccagcccaggcagcaagggcaaaactccatctcaaaacaaaaaaaaacaaaaaaaaaaccaagaatattcatagcagctttattcatactagctaaaaacatgaaacagcacagctgtccatcaatatgagaatgaataaacaaactgtgatatatttatacaatgggaaattgctcaacaataaaaagaaagaaactagatatctgcaacaacttggacgcatcttacaacagcctctcacaagagaatacagtccttcctcattatttgtgaattctgtatttgcaaatttgcgtactagctaaaatttgtaacccccaaatcaatacccctggtgcttttgtaatcacatgagtatgggcaaagagtcaaaaactttgaacaggtcaggcatggtggctcgtacctgtaaccccagcactttgggaggccaaggtgggaggatcacttgagcttaggggtccaagagcagcctgggcgacaaagtgagacctcatctttattaaaaaaaaaaaaattaaaaaaaattttttttgagactaagtctcgctctgtcacccaggctggagtgcaatggtgcaatctcggctcactgcaacctctgcctcctaggttcaagcaattctcctgcctcagcctcctgagtagctgggactataggcatgtgccactatgcccaactaatttttgtatttttagtagagatggggtttcaccatgctggccaggctggtctcaaactcctcacctcgggtgatcctcctgcctcagcctcccaaagtgctgggattacaggcatgagctaccgcacccatcctctactaaaaatttttaacccttctttggttgaagccgcagaaacaagatgacaaaggaaacgtcatcgtttggaaagcatcgcgataagacacacactttgtgccgccactgtggctctatggcctgccaacttcagaagtcgacctgtggcaaacgtggctaccccgccaagcactagaggaagtataactggctaaaagacaaaataccactgggactgatcgaatgaggcacctaaaaattgtatactgcagattcaggcatggattctgtgaaggaacaacacctaaacccaagagggtacctgttgcagcatccagttcatcttaagaatttcaacaattggccgggtgcggtggctcatgcctgtaatcctagcactttaggagcccgaggtgagtggatcacgaggtcaggagttcgagaatagcttgatcaacatggtaaaaccccgtctctactaaaaatacaaaaataagccgggcgtggtggcgctcgcctgtaatcccagctactcaggtggctgaggcaggagaatcacttgaacctgggaggcggaggttagagtgagccgagatcgagccactacactccagcctgggcgacagagcaagactctgtctcaaaaaaaaaaaaaaagaaaagaaaaaaaaaaaattcaacgagtcatgcaaaaagtgttctggtttattaaaatacaaaaagaaattttttaacctatttcctgtttgccttgagaatactcttgcctgtaatcctaatgtaacatcatatatacttctgttacattaggattagagacaagttctgtttagaaataactccaagtaaggtttttatattttattttcatattgaaaatcagtcataatttcttcagcctcaaagaatgagtttatgtaaaattaaatgagtgctggcagtgagctgcactttttttctctaaacgggaaatgggtttaaattttttttttttttttttttttttttttttttttttttttgagatggaatcttgcagtcacccaggctggaggaatgcagcggcacaatctcagctcactgaaacctccatctcctgcattcaagcaattctctggcttcggcttcctgagtagctgggattacagatgcataccaccacacacacccagctttttgtgtttttaatagagagggggtttcaccttgttggccaggctggtcttgaattcctgacctcaagtgacccgcctgcctcggcctcccaaagtgctgggattacaggcgtgagccaccacacttgagacttagatttaaaaaaaaagtttgaagggccctgagttggaataaagcaatactctgcctttgtgagctctgatactgtaagcattttgtttttgtttttgttttttgagacagagtctcattctgtcacccaggctgaagtgcagtggcacaatctcagctcactgcaacctctgccttctgggttcaagtgattctcctgcctcagcttccagagaagctgggactgcaggcactggccaccacacctggctaattttttatatttttagtagagatggggtttcgccgtgctggccagcctggtctcaaactcctgacctcaggtgattccacccacctcggcctcccaaagtgctgggattacaggcgtgagccactgcaatggccaacaatatattatattaaagaaagtatctttaaacaaacacacataaaacaaggttttgtactgatcagttgacaaaaaaaatgtgaccatcgcccactagaaacctaaccctgtatttctctgggggcagtgattcagtatttgctaattcagtgtttgcagcaactttatagaccaccaataacaagaactgactatacatatggcatgattgcattgtattaaaatctagtacaggcaaaactataatgaaaaaaatcaaaatatattgaaaaaatcagtagttatctctatgggggtggatggagactgactgggaaggaacataaaggaacaactctggggtgaaagtcatattctagatcttgatagggacttgggttacacagatatatgtatttgccaaaattcagcaaatgtgtgttaagatttgtacacttggccagacatggtgactcatgcctgtaatcccagcactttgggaggccgaggtggccagatcgcttgagtccaggagttcaagactagcctggccaacatggcgcaaccccatctctactaaaaatacaaaaattagcaggcatggtggcgcatgcctatactcccagctactcaggaggctgaggcagaagaatcacttgagcctggaggcagaagttgcagtgagctgagatcttgccactgcactccagcctaagtgacagagtgagactctgtcttaaaaatatatatgtatttgtacacttcattatatgtaaattgtacatcagaggaaaacactgtaatttttttttttaaatcagtggagggccgggcgtggtggctctcgcttgtaagcccagcactttgggaggccaaggcaggtagatcacgaggtcaggagttcgagacaagcctggccaacaaaatgaaaccccgtctttactgaaaccccgtctttactaaaatacttaaattatctgggcatggtggcaggcacctgtaatcccagctactcaggaagctgaggcaggagaatctcttgaacccaggaggcagaggttgcagtgagccgagattgcgccactgcactccagcctgggcgacagagctagactctatctcaaaaaaataaaaaataataaaaaaataaaaatcagtggaggggtccactattagtttggatgtagaaagactcactcccggcctggcacagtggctcacatctgtaatcccagcactttgggaggccgaggtgggcagatcacctgaggtcaggagtttgagaccaacctgaccaacatggtgaaactccatctctactaaaaatacaaaaattaaccaggtatggtggcacatgcccgtaatcccagctactagtgaaactgaggcaggagaatcgcttgaacctgggaggcagtgagccaagattgcgccaccacactccagcctgggcgacagagccagactgtgtctcaacaacaacaaaaagacttataccctaacaaccaaaataatccaaataaattgtaaaattatacacacccacaattatttttttggatataggatctcgctttcacccaggctggagtgcagtggcacaattatggcttactgtagcctcgaaccctgaggcccaagcagtcctcccgcctcagcctcccaagtagttgggactacaggagcttgccaccacgcctcgttagttttattttttgtacagatgggggtctccctatgttgcccagactaaaaatcgtattttaaaaaacacatcagagaagtggggattcaaagaaacctatatcaactaaactccagaaaatgatgagttcttcataatcaaggagagacctccagctgctactcccacctctggcagaacagcagtagtaaaaaggaacatcagaagtggggacaaggagaaagtatccacttttaagagacttttaatgactatgtgtgaggtagcataccagatgagaatcccagggaccacagccacaaaatatgtctttccgtacctccgaactctttcctatggatcctcgcctagagctaaggggcggtatgcaaaaagctgggaacagggaaggagagctgagatctttctgaggtatgtaaagtttcttgaaagtgcagagtaggccgggcactgtggctgacacttctaatcccagcactttgggaggccgaggcaggtggatctcttgagatcaagagttcgagaccagcctgacgaacatggtgaaactccatctctagtaaaaaaaaaaaaaaaaaaaaatacaaaattagccaggcatagtggcacatgcctgtaatcccagctacttgggaggctgaggcaggagaattgcttgaacccaggaagtggagattgcagtgagctgagatcatgccattccactccagcctgggcaacaagaacaaaactctgtctcaaaaaaaaaaaaaaaaaaaaaaagcacaaagtaactgcccttagaaggaggtggtagggaagagaatttaaaaacccagaagtggtcctctgggatttcatcttttgaaggctgagggttaggtaggagggctgagagaaacctcccccactaggctttcagctatcagatgctacaggctcagctggagagccaagagaacccttctgatgcattctagacttttacaacgtaaagtggagaccctccaaaggccagaggagggaaagcaggactaacaaggcacagaggaaaggaagcagactcaaaaagcacagagaatgccccagcaacccaaacacctggttggtggtttgtaaagcagggagagcttacccagagttggagaattggcagtttgggtgtgaacaagaaacagatttctggaatcttgccagttctcagttctaagcctggatgaaaggacaatcgtgatccttcaaaaaaacatttgaagcccaaagtgaactgaaccaaaccaaattcacaactaagcccatttcaaatacaaagcataatgacttggtcctcactctctagagtaaggcctagtgtaagaagagaaatgccatttcctggacatatatattattttagtcactaatgttttatacaaatatccaggcatatgataaaaaaaattacaggacggagttaaagcaaaactcatggtcaagaggaaataatcaatagaagtagatgcatagataacccagatgttggaattattagataagcatattaaaataactgtgatagaaatctaaatgatctagtgaggaaagtacacaagaattaaaagatgggtgatttcagcaaacagttgaaaactggaaccaaaaggaaataatagaaattttaaatatatcaggcaaacagttctacaatagttggagtcttcagtacaccacttacaatagcagatggaacatctatacagaatattattaaggaaatagacttaaaacaacactaaccaactatacctagaagacacatacaaaatactccatcataacagcagagtacacattcttctcaagcactcacggaacattcttcaggatacatcatatgttagatcacaaaacagtaaatttaaaaagactaggctggccgggcatggtggcttacacctgtaatcaggcagagattgcagtgagccaagattgtgccactgcactccagcctggtgacagagagagactgcgtctcaaaaaaataaaaaaaataaaataaaaaataaaaaaagacacaaatacctaaaatcagaaatgaaaggaaggacattactagcaaccttatggaaataaaaagattgtaagagaataccatgaacaagtataaaataacaaattggattatctaagatgaagttataaaattcctggaaatacaaattatctaaactgactcaagaagaaatagaaaatctgaacaaatctataacaattaaagagattgactcagcagtcaaaaacttcccaaaaaaagtcaagaccagatgccttcactggtgaattctaccaaacacttgaagaagaattaacgccaatccttttcaaactcttccaaaaaatagaagagggaggaacacttcgtaactcattctatgaggccagctttaccttgatatcaaagatagataaatcacaagaaaagacatcaaatcattacatgccgggcgtggtgacttaggcctgtaatcccagcgttttgggaggccgaggcatggaggatcccttgagccccaggagttcacgaccagcctgggtaacacaggaagaccccatctctactttttaagtactttttttttaaatcaaaaaagaaaaaagaaaattacaaaacaatatcccttataaatacacagatgcaaaagtcctgaagaaaatccaatgacgtatttaaaaaatggatatacaccattgataaaaggaattcatctcatgaatgcaaggatagtacaacctaaggaaatcaatcagtgtaatacatcacagtaacagaacaaaaaagaaaaaaacatgatcatcttaatagacacagaaaaaaagttcgataaaatctaacaccctttcacaataaaaacgcaaaactaggaatggaagagaacttcctcaacctgataaagggcatttatgaaaaacactgctaacatcaaacttaataaataatgaaagctttccccctagaatcagaaacaaagcaagtgaaaattacaactttggctagttgtggtggctcacacctgtaatcccagcactttgggatgctgaggcaggagaatcacttgaacccaggaggcagaataaaattacaatttcagaaaaagtatgtgtcttgtatctgccattgtgagcttgacagcttgccaacactcgaagatttttgtgactggacatggcagctcacacctgtaatcccaacactttggaaggccaaggcaggaggactgcttgagctcaggagtttgagaccagcctggtcaacacagcaagaccccatctccatttttttttttttttttttttttgagatagagtctctgtcacccaggctggagtgcagtggtgtaatctgagacctgtcccgagaccaaaaagtttgagaaccactgccatagaaaagcaccaggacatgtaccaaaatggtctcggaagcattgtttctaatcacaacccattgggaacatctcacatacccatcagcagcacaatatgttatatatatatatatatatatatatatatatatgtatgtatatatttagtgcttcagacaagggaggtcatgctcaaggcagcctactctcaaatcttcatccaaagaaatcctgaatgttccctgggtctctgctggattctagaactcttgtcctcacccttagctactgcaaatgaatcttggtcctatgcccacagcaattagtcccagccctggcatcattccaaaggaaaaatgttaaatcacacctgcccgaggcctctggaatggttcaaaagcttagggaaaagggtgtacagggtaggaaagtggggtgagtgaggcattacctcctcagccagaaagcgcagttttgccaggagcttcttggccagtgccaccttcttttgcacattgcgccgtctcaggccgcgtagaagtcgcagtccttgcttagccaaaaggttctgggagggcaaaaagacagcatgagcggaaggccccagctaggcgcccctgagtcccttcccgaggccgtaccaggctgtgcaccaggagtttccctcggcatcgatccagggcattgggccgggtcatcgtcctgcgctcggcaccgtggcaaaactgtctgcagtgagcagggatgtgcacagcagacaggaatcaaaggaaaggagaaggacagtgaccttggggccacttgctctgagctgacctcccacccccagcctccctcatagccctctcagtcttgggctctgaagaggcaccctttctcctgcaaagctggcctatctctatttggaccactcccaaaaatcattaaggccagccttgctcttgagctccagagctcgctaatacttaaccacctactaccctggctaccccaggtgtggcccatggaccaacagcactggtatcacctgcaggctatttaaaactgtaggacctcagccccaccccaggccctgctgaatcagaagctgcgtttatgccctcggggattcctaagcacattgaagcctcagacgtctccaccagcttggctaacgtatagcttgaacattacatgcccaagccaaatgcatactttccaatgatcccccccgcaaaacaaaacaaaacaaaacaaaaaccctatttcacctcagaactttcgagtcatctctcactgctctttctctcttattccacatcaattcatcagcaaattctttatgctctaccttcaaaaaatatccagaatctggccaggtgtggtggctcaggcctgtaatccccgcactttgggaggccgaggcggtgaatcacttgaggtcaggagttcgagaccagcctggccaaaatggtgaaacaactgtgtctactgacgctgaaaggttgagcatggtgagaacagaaaagtgaccacctacagcctcctacctcactgcctctcctgatcagggtccttggctgagtccctgcttcctccctgcctctaaatgctggaacgctccaggttctcagatttctcttttctgtgctctgttaatgctgttatccagctccatctacataatgatagttcccaaattgacatttccagcctagaattctccccagaactcaactcatatagctaactgcctaccacacatgtccacttacaattcaataagaatttcacagttaacatgtccaaaactgagctcctactatctgccttccctcagatcccacctcatccctgcttccatcagaccttctcctttgttttctgttgaaaacagatttttttcttttttccaaaaaaagaagattttggcttgcataactatgcagttggtgcagccttaaactcctggactcaagccatcctcccatctcagcctcctgagtagctgggactacaggtgtgcaccaccacacccagctaacttttgtatttttcatagagacaaggtcttcctatattgttcaggttggtttcaaacccctgggctcaattgatcctcccaccttggcctcccaaagtgctgggattccaggtgtgagccaccatgcccagcccacaagccaaaatcttagcaagtcctgaggtatcacccccaattccaaattttctctggaatccattcacagcactccatctccactgcaaccatcccctagatcagttcatcgccacctgtcacgtggattatcacaatagcccctttactaatctccctgcttcctcccccactgatcccttttaaggatctatgtgttagagtgtatctttttccttttcaaaacattcactgcccctccccccccatttcactcagagaagaagccaaagtcattaaaatggcttgtgaggctcccacaggatctgtccctccccaccatcatcctccttcccctggcctcctccagcctcttctactatgtcacactgctgcagtcacactggttctgtgctcctcctcaaacactccaggcatgctgtcccctccacctggaacaccattacaggcaggctttctcctccagcttcatgtcaccttcacggtggcctcccctccacaccctttctgaaattgcagtacctctttctaatgcttccttgcttcgcgttctttcttaacacttatcctacttagtatttttctatctgtttacatgcttatttcacatgtctccacccttccccaacctctacacccaaatgtaagcttcagggtttttttttaaagtcagggtcccattctgtcacccagactggagtgcagtggcgcaatcatggttcactgcagccttgaactcctgggctcaagatcttcccacttcagcctcccacaagtagctgggactacaggcatcagccattgtgcctggccaacttcagggatttttgtgggcaggaatgctttttcactgatattcctgtgcctaaaacagtgtctggcatagtaagtgccataaatagttatcaaataaagaacccttttgagaagaggatctgaaaatcacttaagtacctggagcaggtaatggaattcagggcagtagtgaaggtcaaagatggaagtaactagaacatgttttttttttgttttcttgtttgtttgtttttgagacgtagtcttgctcagtcacccaggctggagtgcagtggcgcaatcttggctcactgcaacctccacctgccaggttcaagtgactctcctgcctcagcctcccaagtagctgggaggtacccaccattatgcccggctaatttttgtatttttttggtagagactgggtttcgccatgttggccagtctggtcttgaactcctgacctcaaatgatctgcccgcctcagactccaaaagtgctgggattacgggtgtgagccaccgcacctggccgaacatgtttatgtggttacagcaatgacctggtaactagggaccaatcaatgatgaaggggagaaaattgacaattacagaactaattcctccagtgatgaaatccagatcacagctgtggtcactggagcaggaaaggaggagagcagatggatgcagaagccggcaaggaggtagactgggtgtgggaaggtgattagcaggaacaagtgtgaaagaaaggaggcgaggtttgaagagacacgggataagcctctaggagcgtgggaaagggaactcatggagatggaaaacagctgaggtgccagagaatcaggggaagcctaacccccaataatctcatcagctccctggataggaataattgtcttctcatttttctgtaaggtgctgagcaaatgcagctgcaagctgcccttgggtccagacagccaccgagagtctcccttgccctggagttggcccaagtacaggcagcagtaggagtggctctcagctcacctgctcccagccaccagtacttccagtgcctgcttgagctgtgcacaggcgccaggccccggcttgcgctgcagtctctcaacctcctgcagcccctggtcctgtgcaacgtgggagagggtcagagtcttgagggtccctgactcagacctcttgtagaccacacccccacccaaggccccacccactcacgaccacacctcttggcctgcccttctttggctccatcaggttgatggctccatctttctagcccgctactggctccaccaaatgtgcggccccaccatccgtacctctacccatctccttcatccagtcccttcctgggtccaccaattctgaaactctgtcctcccacaactcctggcatcctcggttcgcccagaagctgtgctctttggcccttgcccccctggccttgcaccagcaaggtgctggctctctagtgcctgcccattagccccactgcagagcttccttcaaaggctgcagtgtcctaggcgtccctacggcccggtctctccctgtgggcgccagccttgcccttaccagcctctcggccactttgcgcacgcagttgctgctctgcaggcgccaggtgtggtcctcccagcaactccacacatgcatgcatggcttgcagtgacagaggggcaagcagaagtatggcctggcagatggagaggaggcttcgcgggcattctgggttcctggagacctcccaaacccccccttccagccaccggcagcactcacccactgccgtccatgggctcaggccgctgagcatgggtccccagttcttcctcctctttctcctcctctggcctggctcccagcagaggctgagcctccacggctgcaccctcagttccctccccagccctggaccctcggcccaattgctcctccagacggcctgcgcgacctgccccagagcagcaagggtcagtgggcgccaggctgagggctggaaccccccctcaaccacctctgcctcaacagaagtcagaacctgccccttactgaaagtcaacaccccttccagggttctaaggtctgaaatggcactcaggggttcggctaggccacacaccaatggagatctcgaagctgatgggctgggaggccacggtggggtcgatcatggtggcctcgaagagcacaccgaaaagcaggaaatcttcacagggcgccaggacattctgggggaggccatcaggctggagtcagcacctactctcccagggaacagcctggactatgcttggccgcattgcccacagaaagaagtgcgaccaaggcttggaagtcactgcaggtttcttactccctctccctcctcccggccccagcattggccctgggtatgggtcctctctcccacaacatgtgtgcatataccagagcccatgtgggcacacacctcactcttcgcccaggcccccaaattgagacccctgtcgtggtgtttaatgcctgagagtggattccaccttccagagctgaggtgaccccgccccctttgctaccccccagcccccacctctggcagcggcagcagctcctccacctccacctccatggcacgggggatctcaggcccctcggcaccggggctggcgtccaagtgctgcggaaccgcctttggggtctgatcccttctggctttctttttcttctttcgggtgagccgggacaacgtggacccctgctgggcctggggaggctcaggttcagctctcccttccaacacctgcatggacacagccagcagaaggcggccgcggaaccaaatgccttggccaacgccttcgttgagaccttgaagactatcccggagccccgcgccggggggcgagccatagaggggcacccaggccgggccgaaggtagggttaaaccccgctgtggggaacaagagaagcgtgttggaggggagcgtggggagggcgagtgctggtaaatctctgcacctcaccctgatctcctccaagtattcgggggtgagggcaggggaggggggctaagccgctctgaaacggaagaagttggccagcagctgcggacgcgccgctgtggaacacgacctggggcgcctccaaaacagctcagcgccccaaggagctggaaatcgcgggagcccggcctcgggggacgcagcctgagccctgggggcggggtcgggattggggcggagctacgggcgatcggccaggcctgggggtcggggaaaggagtggaccggcagtgtcagcgtgtgcacagctgtagaagggtgggactgggctggttactggacaggcggttgtggtcagaattttgccaacggagccaaaccgatggtggggttcacagtctgggggcggcttgaagcagtttgttttgcgggcggaccagccctcctaggcggagcggggtcgcgaggatggggcttgcggttgggaatgggccctatggagccctatggaccgaggcgagtgaggccagatttgccgcggccagaagcgctcacccgcgcggcccggatgggagatccgcctcaggtccggcacgtgcgtagcgagtgccgcgtcgaccaggggcgcgtcgtcccgcagctgcaggcggaggctgcgcgtcagcggcgggaagagctccacgaagctcagctgctcgttccattcgggcgccgccgcctcggcgctcaccgacgtctcgccctgaaggtggcgttaaagacaggagaagggagatcagcgcggagtcggggccggagccgcggcgccgtgggccccggagggacttacctcctgccccaggaaagacacccgcacatagggctccaccaggacgcgctggtcgtgcagggcgcggaccaggctgcccagcagccccaggcgcagcgcgggaagcccctcggcgcggtacaggcgcacgcggagccgcgcccatggcctctcggcgggcaccccgcgcggcaggagcaggttcctaggggagggggcaccgagcggggggggagaaactgggatctcggcccctccccttatccgcgccccacggccacccccggatccatgtcctcctccccacctcaccccggctcacttctcgatgtccgaacagtgccctggggccgggggtagcattggagggggcaggtccccgcgcgccctcacggacaaggtgaccttaatgaaacccttggtcccggcgcgggtgtctcggggatcatgcagcggaacccatctttggtagaactggccatctaagggcgaaggggcgagccaggggtaaggggcgaccggcgggacgcacagggtggccgtgaggctatcggagtgacggacaatggccagggcttctctggctcagcagggaggggcggaagtgccaagagttcagcctccgccagagatggccctctccgaagtgagtgtataggggtccatgcggagtcactgcagggtcaatctctagggcccttgtccgtgcagagtctcaataaggggacgattccatacctggctggtccaagatgatgcccaggtccatcctgaaggtgcctatccgggtggccataaaggggagggtctgcgaatggaaagccttgggggaaggtggtgttagtcctgcagctttctcatccccccttctctgaaggacactggtcacccctaccccactcaccgtgatctccagcagcaagtcttggagacgaagccgcgtgtcatgaaattcgaacaagaagtactgaattgaagtggggatgagaggtcagatgtgaagggctcctgccagcttacccaggtctcttgctcagaagaccctccttcccccacccccaaccctctcactgcaagcttttcctggatcagcaaccccccaaccccaacccataggcccagcatctggctccatttccacctaggcctcacccgctccgggaatagttctcacatcaacccctcccattctgtcaggctcgccctcttctgtggtggcacccacctcattgtagaaggggcaactggtcccacgctgtgtggcggtcacacggcgctgcccccccacttgcacggccacataggggttaatgttgactcccaccagtttctgggcttccagcacagtgactcccacctgagaggtacagaaggatgaggaaaggaagccagacctgcctgggtggagggaaagaacatgcgtgccagaagaggtagtacttccaagggttaggccctggaaaaagagtagtacctggaagtcttgagctctggacacctggaagggatccccatgggccagggccctggcgcggctggagagaagcttaaggttagcactcacttggtccctcccctgcacacgcacacgcgcgcacacacacacacacacttgcttggtgctgggaatgatgttttctctccctctgaatttttggattccaggtccttcaggtcatgtcttgctgcctccatctcaaccctgcacccacaatttgactcattcctggagcccgaaaccattcattcatgcaacagaggtttattgagtacctactatgagctaacactgtcccaagcactgggacgctgtagtgaagagacaaatcttgccctcatcaagctttcatcccctgcatgtgtgtgagccactgtaactatgtgtatgaacatggcagtgtctatgcctatgagcaagtgactggagaatccacccttcccacaccccctgggactgtgtgtttgtgagggcagatgggtgtgggagcaggtgtgccgtgggtacaagttacctcttgagggggctgaacataacaccagaaagttccacgtcaggctcatcatccaggtcctgctccagctcaagctccagctcattctcttcatcgtcctgctggcctagacttcgagctagcctgcggcctagagccactgcccgccgctccagctgggcctccccaggcctgataggaaagaccctcaagggacatgcctggaacccatcacccatctccaggcaatcccttgacttcctggagccttggactgacccctgacccttgaactgatcccactgatcctaggaccagttattgaccttgtggctgacttcactgatcccaggacagactcttaaccctgggacatttctaattccagaactgacctctgattctaggactgacctctgaccctggaactgattcagttctgacccaagaccctggggctgcccccatatcactggctcctaactccaagactgactcagtgactccaggtcatccccacatacttactccagttcctggaagcccacattggggatgattaactcgaagctggggaataataaatgaaaggactaagaggaacattcctaactacagagcggcacctgctcagcacacgtccaagggtcactgaatcggcagatccagagtggaaccgggcactacttctccctttccagggtctgcctgggctgggaccaccaggtcttgcttcagttgctgaggggattacctgtcctggatgggtgccccaaagtcctcctctgaccaggctccagtagcgccctctgggggctggtacttcaggtcaagctccacctggatctgaaaccagatacagtatcccctagggccccccatctaactgccctgggtctaagagaggcccaaggacaatgccagtgccttttactacaggcggcagagatctttctggccagcatccgtggtgccttgtggttcctctctgatcattaataatgtagactactcataacctattaagaactaagtaactaggcaagtttcctcgttatttttttctttctttttttttttttttttttttttttttttagtattgatgaggtcttattatgtaccttgcccaggttggtcttgagctcctgagctcaaatgatccttctgctttagcttcccaaagtgctgggattacaggcatgagccattgtgcccagccgcaagttacctcttgaggcccaacaggattccaaaattgtctcatttttgttggaaatcccttacggtggccttcactactctgcctggtctggccccaccaacctttccagctccatctcactccaggcaccccagctgtgctccttcaaggcgctggacttttgcatatgccttttcctctgcctggaacattctctcctcccagttaacatctgttatccttcaagtctaagttcaggtactatttcctcagggaaccttctctggcccccaagtagatcatactcccctgtggtaccctctcccagcccctaccagctttcttctaacacctgccagttccagtttcacacttacttgtgtgaatatttgtttaatgtttgcctcccttccaagggtgtgaatctttatctggttttgctcaccacggaatcctcattgctcagctcagcatttggcttatcataagagctcaacaaatgatgacggactgaacaaaagaactccacattatataaatgagaaaatagcttccaggccaggtgcggtggctcatgcctgtaatcccagcactttgggaggccgagggtagatcacaaggttaggagttcgagaccaacctggccaagatggtgaaacccagtttctcctgaaaataaaaaaattagctgggtgtggtggcgggcgcctgtagtcccagctacttgggaggctgaggcaggagaatcacttaaacctgggaggtggaggttgcactgagccgagattgagccactgcattccagcctgggtgacagagcaagattccgtctcaaaacaacaacaaaaaaagaaaacagctaccaaatgctaaagaacgtgtacaagttcccagacgggaaatggcagatctgagatttgaagttaggtccatgtctactaggctatgagcccttccatgaaacaccaggaaaatccagccaggttcatctttgtctcccaaaagaattgattgctgaaaggaatcctggctggaggccttgttaccactcctctctgggtcttaggttttcccctgtgagaaatggaaccctttatctagaggtacttaagggtggcagcctgggggccagaggggctcaccggggacacttgaagattctcatccactagggcttcccgtagcaccaaatgcccagcattctgtagctgctgcagggagatcaccagggtccctagaggcctaggggagtggcatagagcaaaagagtgacccaagagaatggctctaagtcacccccagcccaacctgcatccctgtctccccaggcctactcacctaaggctgaatacacggctgcagttgaccacctgcacagacagacactccccagccagtggagccccatagtggggccatcggaacagctggggacaggaggaagcttgtgacacccatgctgtgctgaccctaaactccaatccaaagcccattcttggctgggcacagtggctcacgcctgtaatcccagcaccttgggaggccaaggcaggcagatcacttgagatcaggagttcaagaccagcctgaccaacatggtaaaaccccttctctactaaaaatacaaaaattagccaggtgtggtggtacatgtctgtaatcccagctactcaggaggctgaggcaggagactcgcttgaacttgggaggtgaagtttccagtgagctgagattgtgccattgcactccagcctgagtgacagagtgaggccctgtctcaaaaaaaaaagaaaaaaaaagaaaaaaaaaaaccctattcctaaccctcagacaggagccaatcctccagacttagagctaactttaggactaacatccccaaacctggaagggatccctgcacatgggtttgaatctgagtgagggctgatctgggactaactagtgatcaagaatgaattcccccagtcttgcaactaatttgttccaatctgggtctgatctctcaggcctcagactgaccccacctcccaagactatacttccccaaacccaggaatgagcccctgaaccccaggttggacttggatgggagacagatcaggaaccaactgtactgacctcaccgatatctgcttctggaccacagtgaatttttcttgttttctgggtaaagcctgctcagaactgaaactagtcatatatcagcccctccccccacacacacaaaaataatttgcttcccccactcttggcccagtgtcaagtccctcctggattcacccttaaagaaaggtagacaatgggaaggaaagaggcagagggttggagataccagtgtgggtagagaaaagaaatgggctgtagagatgggaaggcattgggtcaagggcccccagtttcaaatatccttagggcgcccctgcaagcctcacctcgaaaggtgagcttcacttgtcggtcgtgggtgccggtcagccctgttagtcgttgcacgcgttaccgtcagagccatggtcccagtggcactggcacttcctctgcccgtctgcccttctgcccaccagcccgcccacctgaatcgcctctgactcactggactcacccagcaggtttagcaatccctaccctttagtcaaacacacagggagcaggcctgggggtcatgggtggggagggaggagaggaccgagggataggggtaaggtcctggaggtcaattcagccctccctgcctccaccagctgcaagctggcaggactgcctcagcctccatcctgcatcctcagggagtgagagctgtgatagggtgggagggaggcaaggggagtgaacaggaccccagtctgctccctgccagccgatgaggcctcaaggacatggacctcatgccttttcgtttcttttttctttgtttttttgttttttgttttttggttttttttgagatggggtcttgctctgtcatccaggctggagtgcaatggcacgatctcagctcactgcaacctctgcctcctgggttcaagcagttctcctgtctcagcctcccgggtagctggaattacaggtgtccaccaccacagctggctaattgtttgtatttttagtacggacagggtttcgccatgttggccaggctggtctcaaactcctgatctcaggtgatctgcccacctcagccccccaaagtgctgggattatgggcatgagtcattgtgcccggcctctcctcttttctatctctctctcgctctcttttatttttattttttttactttcttccttctttctttcttttcttttttttttttttttttttcctgagatgaagtctcactctgtcgcccaggctggagtgcagtggtgtgatcttggttcactgcaacctctgcctcccggattcaagcaatagtcctgcctcagcctcccacacagctgagattataggtgcccgccaccatgcccggctaatttttttttttttttagatggagtctccttctgtcgcccaggcaagagtgcaatggtgtgatcttggctcatggccacctctgcatcccgggttcaagcgattctcctgcctcagcctcccaagtagctgggattacaggcatatgccaccacgcctggctactttttgtatttttttagttgagacggggtttcaccatattggccaggctagtctcaaactcctgaccttgtgatccgcctgccttggccttccaaagtcctgggattacaggcatgactcattgcgccctggctaatttttgcatttttaagtagagacggggtgtcaccatgttggccaggctggtctcaaattcctgaccttcagtgatctgcccatctcagcctcccaaagtgctgggattacaggagtgagccaccacgcccagccccttcctttctttctttttcctttttttaaggcagggtctcactcagttacctaggctgaagttcagtggtgcaatcaaggctcactgcagcctcaatctcccaggctcagcctcccaagtagctggaactacaggcatgtgccagtgggcctggctaatttttgtattttttgtagtgatggggttttgccatgttgctcaaactggtctcaaattgctggcctcaagtggtcctcccacctcggactctcaaagtgctgggattacagacgtgagccactacacctggcctcatgttgtttcttgttcatcttcctgttctcagtgcccagatcagggtttggcacatggtagacccttaaaacactgaacaaatggatgaactaataaatgaatcccttagccctcagaagtagtgctgtaggcattcaacacatttattgaattaaaaagtgattaaatgtgtgttcctagcttgcaacatagtaagcattcagctggaagccaggtgtccttaacttggggtcctaggatcctagtgggaccatagaatggctccatggaggctgcaaatctttgaaattttctgcaaaatattgggcatgtgtacacttttgtggactaagagctcatcacttaggttaataaccctaaaacagatgtacaatacttttgctgagtgaagtcatgaatgtatcttgaaatctgaacccataatatgtgaaagtatgtattcactggagttcacagccaggccctttaattatatacatatataaaattttttttttttcagaaagggtcttgctctgtcacccaggctggagtgcagtggcacaattacagctcactacagcctcaatttcccaggcttaagtgatattcctgactcagcctccctagtagctgggtctacaggctcatgcaatcacaccagctagtttttttaagaggtggggtctcactatgttgcccaggccggtctcctgggctctagcaatcctccttccttggcctcccaaagtgctgggattacaggcatgatctaccatgtcctgcaccttctatttgcagggcttgtgctatggcaccctgcagggtgtgcagccagagagaggggaatcacatgtgtctgtcttccagtaacttcatgactccaataactaacacagcctagaaagactggaattaccctgagagcagaaagggtcagggcccaggagctcagaggagggagactagaggcgcttccccaaaaaaggaatgtttaaaatgggtttaggctcccgggaggcggagcttgcagtgagccgagattgtgccactgcactccaacctgagtgacagagcgagacactgtctcaaaaaataaaaataaaaataaaaataaaaaatgggtttaggctcagcacagtggctcatgtctgttgggagcccaagacaggaggattgcttgagcccaggaggtcgaggctgcagtaaactgtaatcatgccactccactccagcctaggctattaataaagcaaaacactgtctcaaaaaaaaaaaatttttttttaaaagaaaagaaagcggccgggcatgatggctcactgctgtaatcccagcactttgggaggccaaggcaggtggatcacaaggccaagagttcaagacatcctggccaacatggtgaaaccccgtctctactaaaaacagaaaaattagccgggcatggtggtgtgcacctgtaatctcagctactcagaaggctggggcaggagaatcacttgaacccgggaggcagaagttgcagtgaagcaagatcaggccattgcattccagcctgggccaacagagcgagactccacctcaaaagaaaagaaaattggcttagagcagtagtccccaacctttttggacaccagtgaccagggaccggtttcgtggaagacaatttttccatggacagggtcgggggcaggggcggcgggtggagaggatggtttggagatgaaactgttccacttcagatcattaggcattagattctcataaggagcacacaacctagatccctcacatgcatggttaccaatagggctcgcgctcctgtgagaatctaatgctgctgctgatctgacaggaggcggagctcaggtggtgatgctcccttacccactgctcacctcctgctgtgcatcctggttcctaacaggccatggactgataccagtccatggcctgggggttgggaacccctggctcaaaggacaggagctaggagcaaagacagaaacccaggcagtgggaagaaatgctgaacgtgttctgggccatgtaatgtgtacagtttggcctgaacacaaggaatgtactgggcggcggcagcagcagcagcagataagattagacagtcagaggagctgggtcttgctgtgtgaccttgagccagtcatggtcccttcttgtgcttcagcttttccatctcagtactgggttggaaagccctgttctgcctatttctccattgttgttgttttgagatggagtctcactctgtcacccaggttggagtgcagtggtgtgatcttggctcactgcaacctccacctcccgggttcaagcgattatcctgcctcagcctcctgagtagctgggattaatagatgtgcaccaccatacctggctaatgtttttatttttagtagagatggggtttcaccatgttggccaggctggtcttgaactcctgacctcagctgatcagcccttctaggcctcccaaagtgctgggattacagaagtgagccactgcacctggccagttgttatgtattcaaatgagtttgagggtctaaaccacatcagacaagagggacaggctgttctgttttttaaaaaggcccagattagacctgaaaccctcagatgctggaggaaggcttcacctccccacagtcttttttttttttttaagacagtgtcagccaggcacagtggctcatgcctgtaatcccagcactttgggaggctgaggaaggcgggtcaagaggtcaggagatcgagaccatcctggctaacatggtgaaaccccatctctactgaaaatacaaaaaattagctgggcttggtggtgggcacctgtagtcctagctactcgggaggctgaggcaggagaatggtgtgaacctgggaggcggagcttgcagtgagccaacatcgtgccactgcactccagcctgggtgacagagcaagactctgtctcaaaaaaaaaaaaaaaagactgtcttactctgttgcccaggctggagtacagtggtgcgatctcagctcactgcaacttccgcttcctaggttcaaccaattccctaactcaccctccccagtagttgggatgacaggtgtgcaccaccacgcctggctaatttttgtatttttagtacagagacggggtttcaccatgttggtcaggctggtctatgaactcctgatcttgtgagcccgcctcagcctcccaaagtgctaggattacaggcgtgagccactgtgcccggctcacctctattaaaaggacccaaaggagttaacggacagaaaacgtggcagaggcagagatggggtggtatggaccagaatttgtagtttgcagtgatttcgccttcctctcccttcttccgtgtgggccctgtggcacctaatgaagcaaggtattgagatcatccctctggagcctggcatgggcatctcccctctgggctagaacatagcttaacagattgtccgtgtgcctcaacccctcaaaaactgccacttccagttcctaacattcttgttttgttttgagacgaagtcttgctctgtcacccaggctggagtgcagtggtgcgatcccagctcactatgacctccgcctcccaggttcaagcgattcttctgcctcagcctcccaagtagttggaactacaggcacacgccaccacacccagctaatttttgtatttttagtagacatggagtttcaccatattggccaggttggtcttgaactcttgacctcaagtgatccactgcctgggtctcacacagtgctgggagtacaggcgtgagccgtcatgcccggccccagctcctcacattctaaggaagttgtgagatggcagttaagaggactgcactcgagggcaggatttgggaattctaatgtgatgcagtgttattcctctacctggacctgtttgcctagctgtgcaacttgtgcatgacatactgcattgtctttcaaaatgtggttgttgtttttcttttttcttttttttttttttgagacagagtctcactctgtggctcaggctggagtgcagtggcacaatcttggctcaccgcaacctctgccttctgggatcaagtgattctcccgcctcagcctcccaagtagctgggactacaggcacgggccaccacgcccggctaatttttgtatttttagtagagatggggtttcaccatgttggccaggctggtctcaaactcctcacatcaggtgattcgcccacctcaacctctcaaagtgctgggattgcaggcgtgagccaccaagcctggccccaaaatgtggtctttaaccaggatcacaaatgtggttgttaaaaatgcacactccagccgggcacagtggctcatacctgtaatcccagcactttgggaggccgaggtgggcgaatcacctgaggtcccgagttcgagaccaccctagccaacatagtgcaatcccgtctctactaaaaatacaaaaaaaaaaaaagttagccaggtgtggtggcacatgcctgtaatcccagctattttggaggctgaggcgggataattgcttgaacccaggaggcagaggttgcagtgagccgagatcgtaccattgtattccagcctggccacagagcaagactctgcctaaaaaataaacaaaaacaaaacaaaagcacattcctgggccaactcagaaattctgcagtatctgcagtagaatcacaaggtgtgcctgggaagctgaatttctataagctgcactgatattctgttacatagcaagagtttggggacctctagtcttctggctgtgaccatctgattcctcattctttcctccatggctcaggtgtgcagcctgagtgtgggtatgacgattggtgggtgctgaattctcaacccacagacccctgggaaaaatgggtctggaggagggacccacagatcctgaatgagctctctgacctgatgtctaggatgagaggagggggctgaagggcttgcagagcaaaggggactaagtatttagaagtgccctgagtgatgccctgctccttcttaacattcattatttgcaaatatttgagcacctactacatgctaggcttatctaggtgctggaggatacagtagtgaatgaaaatctgtgccctgattaagtttatgttctagtgggcatggcaggcaataaggaaataaataaatgggccaggcatggtggctcacatctgtaatcccagcactttgggaggcagaagtgggtggatcactcaagctcaggagttgaagaccagcctgggcaacatagcgagaccccatctctacaaaaaatacaaaaattagctgggtgtggtggcgcaagcctgtagtcccagctactcgggaggctgaggcgggaggattgcttgaggccgggagatggaggttgcagtgagctgagatcatgccactgcactccagcctgggcaacagagcgagactccatctcaaagaaagagagaaatgaaatatatagcatgttagtgacacgtgctgaggagaaaaacaaaacagggaagggggatagaaactggtatttgctaagtgcaattttagatggggttttctaggaagtgctgtgacgtcatcacttgctttaaaagaggccaggcgcagtagctgactcctgtaatcccagcactttgggagccccaggcaggcggataacctgaggtcaggagttcacgaccagcctggccaacatggtaaaaccccgtctctacaaaaatacaaaaattagccaggcatgatggcgggtgtctgtaatcccaactactcgggaggctgaggcaggagaatcgcttgaacccgggaggcggaggttgcactgagccgagattgcactactgccctccagcctgggcgacacagcaggactctgtctcaaaaaataaaaataaaataaaaataaaaatgctgggcgcagtggctcatgcctgtaatcccagcactttaggaggccggggcgggtggatcacctgagatcgggagttcaagaccagcctgactaacatggagaaaccccgtctctactaaaaatacaaaattagccaggcatggtggtgcatgtctgtaatcccagccactcaggaggctgaggcgggagaatcgcttgaacccgggaggcggaggttgcagtggaccaagatcgcgccattgcactccagcctgggcaacagaatgagactccatctcaaaaaaaaaaaaaaaagaaagaaagaaagaaagaaagaaagaaagaaagaaagaaagaaagaaagaaagaaagaaagaaaaaaactgttatagactgagtgccattttagatggggttttctgggaagtgctgtgacatcatcgcttgctgtaaaagaggccgggcgcggtggctgacgcctgtactcccagcgctttgggaggccgaggcgggaggatcgcttgagcctaggagttcgaagttacaatgagctatgatcaggccactgcactccagcctgggcaatgagaaagaccctgtctcttaaacaacaacaaagtcagaaggagaggctgccatggctacggctccaggtgacgtcacggccagctccgtgacgcgcggccagggcagcccgcggagaccgaggctcctctgtgacgtcagcagccggccgggacacagcgggagggcaggtgcggccgcggggcctgccgacttcacgcagggtccgtggggtccccgcggcgcgcagcggctgaaggaggccccagggccttggcgaccgcagcggcggctttagcgtcagtgactaggcagcagggggtcaggatgcggcgaagctcccgcccgggctcggcctcgtcctcgcgcaagcacacgcccaactttttcagcgagaacagctcaatgagcatcacctcggaggacagcaaagggctccggtcagcggagcccgggcctggggagcccgagggcagaagagcccggggcccgagctgcggtgagcccgccttgagcgcgggagtgcccggaggaaccacatgggcaggaagctctcagcagaagccagcgcctcggagccacaactggcagacagcctgtggcgcggcaaccgtgaggggcggggcctcgggtgcgggcggggtcgaccccgggtgagccagtggagggggcggggcctaaagggcggtgctgggcggggacggggctaagatgatatctgggcacctcctacaaggtgggtcctgtagggtaaagggatggtgctaaatgagatcccttaaggggcggagcctcggtgtcctggacggttatgggaaggggcggggaaaatcttgtggttgggtgccactgagggggcgcggcctcaatgttagcgtgagtggctcccaggacaattgggttccaccaagatctaaggctgggggcgggtcatccgtttgggggagggaccaactcttttttttttttttttgcaacggagtttcgctcctgttgcccatgccatgcaatggcatgatctcggctcaccgcaacctccgcctcccgggttcaaacgattctcccgcctcagcctcccgagtagctgggattacaggcgtgcgccaccatgcccggccaatttttgtgtttttagtagagacggggtttctccgtgttaatcaggctggcctcgaactcccgacctcaggtgatccgcccgcctcggcctcccaaatcgctgggattacaggcgtgagccaccgcgcccggccaggagaccaactcttgacggagcctccctgaggggcggggcttcagagggcggagctggagccgggatagggctgcggtgggaccaaagcctgtgagagacttcccagctgtctggcttgtggactgagcaatctgcggcccggtctcgaggggaaaataggtctgtggtccgcaaggccccagtggagcccttgggttcccgcagaaccgactgggtctccagtagtctctgaggagccgctcgaccttctcccgaccctggatctgaggcaggagatgcctcccccgcgggtgttcaagagctttctgagtacgggccaggccagctgcgatcccctctgaccctcgggttcccctctccgaactccagttctctctgagcccccggcccccgtttgagtatcgagcccctctccgagcctcaactcattcctagcccccatccaattatcctagccgaccctctcttcctgagccccaggcccacccccggcccctcccaagccccttctgaacccggacaccacgcaggctgagccccgcctctccctgccgtgggcccctctctgaccctctgtcctggcctcaggcctgctcttccaggggctgagcgtgttgttatccctggcaggagacgtgctggtcagcatgtacaggtcagaggaagggacgctggcgccccaggaacagctctttggagggggtggggagcagggccggaaccttgctggcgcttgagccgattcagatctgattgagtcatgttggcaagagctgggtctaggaccctggggtggggactggagggttgagcaggtcggggcctcagcctccctccggttccccagggaggtctgttccatccgcttcctgttcacggctgtgtcgctgctgagcctctttctgtcaggtgaggggcagtgaattccctggagcccctgccctgggtgctttggaggcaaacccagcacattttctcctacatcctcggtcctgcagctcctggcattcccctgcagaaccccctaattccccctcagactcccacggtcctccccaggcttaaccccctcaagcctctttccactgtccccctatgccggggaaacccattctcttccttttccttctgagacccctccctctctttctccagcattctggctggggcttctgtacctggtctctcctttggagaatgtgagttggggagactgtcttggggtagggggttggcaggttgtgaacccggagattgtgggggtcccctggactgtcggtctgctggggtgggggtagtgccagaggctacaatccttaagaaagggctggatataaacagacttatgagggattgtgcttgagggtctcttgggggctctgatactgggaggtcaaggaggagtcgaggaaaggggacacagtcttcaaaaaggaagccctggccgtttccaggctgaggtaggagcaaggacgacgggagctgagcggctctgtgttttgtcccttcatccaacaggaacctaaggagatgctgactctaaggtgaaagagggcacctagggtgggaaattggggggctcaaagttgcttctttgagaaccttgaaggcgtgggggcctttgggaggtgtccagggggacagggagccaaccccacggcgcccacctcccacctccagtgagtaccacgagcgcgtgcgctcccaggggcagcagctgcagcagctccaggccgagctggataaactccacaaggaggtgtccactgttcgggcagccaacagcgaggtgagccccggcccaccttggaaacccctgatggatccctgctcccagggtcctgagacttaagctccgcccagagccctgcgggatttctcccggtgcccacgaagtccatcccaaagcaaccagctcccagaggtcccgtccacctgtaaaagcagcccgcaagcctcgcccctccaggcctcgccctccctccttgcagagagtggccaagctcgtgttccagaggctgaatgaggattttgtgcggaagcccgactatgctttgagctctgtgggtaagacccggagacactggaagacagagacgcagacaggaaagaggccaagacactgacacagacagacccatgcacctgaccggccgaagacagagcctcggacagcccccacccgcccccagcccccgcgcccccgcgccccgactcccggcaaggcctgggagcctctgagggttacttctcactgttccaggagcctccatcgacctgcagaagacatcccacgattacgcagacaggaacactgcctacttctggaatcgcttcagcttctggaactacgcacggccgcccacggttatcctggaggtgagtctggaaacatcccgggatgggaccccgggcgggacgctgggaaaagcaccaaaaccccgccctacaggcggagcttggctgagccgagggcgtggaggatggcgtttaactcaaggagagacctggcattgctggggactggggcgggctggaggtggagctctgggcgggtcgatggatggggtcgagctgaggcccgggctggggagcggcagcagtcgctctgtccgacggttccgatggtccctccgcccgcctgcagccccacgtgttccctgggaattgctgggcttttgaaggcgaccaaggccaggtggtgatccaactgccgggccgagtgcagctgagcgacatcactctgcagcatccaccgcccagcgtggagcacaccggaggagccaacagcgccccccgcgatttcgcggtctttgtgagtgcggacgaggtcaggaggtgggggattttgcctagagagcccaagcagtcttgagaactggtgccgttatctgagtcttcgcttgctcatctataaaatgaagatactactatttgcctctcagagctgctgtaggttatagtcataaccatatccagatattagttattgcttgcaaagcacttactccgtgccaagcagtttacaggcattcttattttgctgttgtttttgagacagtctcgctcttgtcacccaggctgctggagtgcagtggtgccatctcagctcacctgcaacctcagcctctaggattcaagcgattcttgtgcctcatcctcccgagtagctggaattacaggcgtgcgccaccatgctcggctaatttttgtatttttagtagagatggggtttcaccatgttggccaggatggtctcaaactcctgacctcaagtgatccgccttcctcggccttctgaaatgctaggattacaggcatgagccaccgtgcctgctttgcacccacataacaacctatgatgtactgttatctccccctttaaagatgaagaaagtaatgctcagagaggggaagttatttttccaaggtaatacaactaacagttggcaggattaaatttaaaacctggtttcttcccgggaggtggagcttgcagtgagccaagatctcaccactgcactccagcctgggtgacagagcaacactccgtctcaaaataaataaataaataaaacctggtttcttagagcccacattctgaattacagtgtacgaccatcaaaaaatacatgagaacatgcatatagctattgaatacacagaagatcctcagcaaagttttcttctccccgccccccccgccccacctgtccccctcatagttcctcctttcattcttcacccaccagggcctccaggtttatgatgaaactgaagtttccttggggaaattcaccttcgatgttgagaaatcggagattcagactttccacctgcaggtgtgtttgtctctagggtgaaggtgccaagggagtggggcagtgagggatgaatgatccaggaggagggcagcccttggcatgatccatttgtctccccagaatgaccccccagctgcctttcccaaggtgaagatccagattctaagcaactggggccacccccgtttcacgtgcttgtatcgagtccgtgcccacggtgtgcgaacctcagagggggcagagggcagtgcacaggggccccattaaacatgctgatttttggagtagaattgagttctgctgaaggatactggatcagtgctttcgggggctctgttgggagagctctggctgccgttgcatctaagtatggaggggctgacttcccaatgcaccctcttttcttggagaagtcttgatcaagatcgtaatagcagctcctgtttatggagtgcctaccacgtacaagaaacagtgctgtggacattacacacattacctaacttcattctcacaaccagaaagggaagctgctcaggtcaggaaacttgttcaatgtcacacagctagtgaaaggcagtgacagagcagtacccaggcccaccttcctccagagccagtcctctaactgcagagctgcaggcagcctgaacccacctttgtgctcaattcccagccccagtgggaaagtccccaactcctgctaggtaccggtggaggggtagctacccaccttctgcaggcacacactcaaaagctaaggagacttgataacctctaggaagcttctgagtcacagagctgatgcaggcctggtagcccctacataggttgtcttactgagacctgagttcccaactctgtgtgaggcacagcatagatgatttagtgttcaccagtccctgccctcaaggagcctgacaggggaaagaagagactccaggaaacaggacaatgcatttacagatccaagaattcttcactctaagggtcgaaagtggaattgcagggaaaaaagatggaggagaaggcaacaaaggattaatgagttctacctaggggtaggaaaggaggaccagcatgagcaaagcaacacgcacaacatgcaccatcttggagggcaatgtgcagtatctggtaaaattttaaatataccctttgatctagcacttccacttttaggaacaaattcttcagaaacattcctgttaagtgcacaaagatacatgtacaaagatgttcattatagcattgtttgaaaaaaactgggattcaaatctccatgaataagagacgggtacgctcctacaaaaaaataagatgtaggcattaacaccttcccaatgtgctcatgctttagaagaatatacagactattaatagtgtttatacttttaagaagtgaaattcggcctggtatggtgtctcatgcctgtagtcccagcactttgggaggctgaggagggtggatcatgaggtcaggagatcaagaccatcctggccaacatggatacaaaaattagctgggcgttgtggcatgtgcctgtagtcccagttacttgggagactgaggcaggaaatcacttgaatcgggaggcagaggttgcagtgggccaagatcgtgccactgcactccagtctggcgacagagtgagactccatctcaaataaaataaataaataaataaataatctgggggatttttttataatttgaagatgaaaaagaccccactgagtgctctcaaggcctatttttatttatcaaagcctaagtttagaattatgaactaatgcagcttttctggagggcagtttcacaacaggaaccaaaagccttacaactttttgtactctttactcacagcaattccatttctaagaatgtatccatagaatacatagatgtattcaaaggtaatatttataaggaaatttaacagtgttgtttataaattggaaacttagtaaccaagtagataaactgttataaaaaataagcagccaatagaaatggtaatataagagaatgtctgaagccactgaaagtaatgatatataggccaggcatggtggctcacgcctgtaatcccagcactttgggaggccgaggtgggcggatcacctgaggttgagagtttgagaccagtctggccaacattgtgaaaccccatctctactaaaaaaatacaaaaaaattagccgggcgtggtggcaggcacctgtagtcccagctactcaggaggctgaggcaggagaattgcttgaacccgggaggtggagcttgcagtgagcccagatcgcgccactgcactccagcctgggcgacagagctagactccatctcaaaaaacaaaacaaaacaaaacaaaacaaaaattagctgggcatactggtgcgcgcctgtaatcccagctactagggaggctgaggcaggagaatcgcttgaacctgggaggcagaggttgcagtgagctgagatcgcaccactgcactctagcctgggcaacagagcaagactctatctaaatggtaataataataaatgatatatggataactttttaaaaagcaagttaaactggcataaataatatgtccatattaaaagaattctatatgccaaaggacactataaataaaaagacaacctgggaagaaatattttcaacatgtatgagatgaaggggctaataaccttaacaaaataaaagctataacacatacatgcagactatgaataggctattgagaagaactataatttacaaataaccatataagataccgatccttcatatttaaataaattcgagctgggtgtggtggctcacgcctgtaattccagcactttgggaggccgaggtgagcagatcacgaggtcaggagtttgagaccagcctgaccaatatggtgaaaccccgtctctactaaaaatacaaaaatcagccgggcgtgctggcgcatgcctgcaatcccagctactcaggaggctgaggcaggagaatcacttgaacctgggaggcggaggttgcagtgagctgagatggtgccactgcactccagcctgggcaacagagtgagactccatcaaaaaaataaaaataaaataaaaaataaaataaattcaaactaaaaatgattttttgcttctttttttacctgtcagattaacaaaaggtgtaactttgaccataatttttgttatgaagaataatttgcaatatctattaaaatttaaaatataacctttgatatagcatttccacttttaggaataaatgtttcttcagaacaaatgtttcttcagaaacattccagttaagtgcacagacatatatgtacaaggatgttcattacagcattgaaagaaactaagactcaaatctccataaataagagatgagctaaataaggtacactcctacaaaaaaaaaaaaaaaaatgatggccaggtgcagtggcttatgcctgtaatcccagcactttgggaggccaaggtgggcagatcacctgaggtctcgagttcaagaccagccaacatggtgaaaccccatctctactaaaaatacaaaaattagccaggcatggtggtgcgtgcctgtagtcccagttacttgggaggtgaagcaggagaatcgcttgaacccagaaggcagaagttgcagtgagctgagatcacgccattgcactccagcctgggcaatacagagcgactacgtctcaaaaaaaaaaaaaaaaaaaaaaaggaatgaagcaataggttctgataggtaagacaccaaaatgtattaaataaaaaggtccaagtagtacgtataaatagcccattgataaaaatctatttttcagatctaggaaaaacaggggcccttacctgctccactatttgtacaatgtgtttttgttttttttttttgagagggagtctcgctttgtcacccaggcaggagtgcagtggcgccatctcagctcactgaaagctccgcctcctgggttcccgccattctcctgcctcagcctccccagtagctgggaccacaggcgcccgccaccacgcctggctaattttttacattttttagtagagacggggtttcaccctgttagccaggatggtctcaatctcctgaccttgtgatccgcctgcctcggcctcccaaagtgctgggattacaggtgtgagccactgcacctggcctatttgtacaatatttatatttgaaataacttcatactaacaagcacgtattttaaaattagaaaaaacaaattttaacacatgctaaaacagtatgtgtagacaaaaagttatgtgcccaatatgttttatcaggacatgggagtttgagtgatattttttctgcacttaaaatttttttcttttctgagacagagtctcgctctgtagctcaggctggggtgcagtggtgcaataccagctctctgcatcctccgcttcctgggttcaagcgattctcctgcctcagcctcctgagtagttggaatcataggcacccaccaccacaccaagctaatttctgtatttttagtagagatggggtttcatcatgttggccaggctggtcttgaactcctgacctcaaatgatctgccctcttcagcctcccaaagtgctgggattacaggcatgagccaccacgcccagccagaatttttctacaatgaatacatgtattctctattaagaaaaaattagctgttaaaaaaattcaggattttcacttgtctttaggaccaaaattaccactactccctcccctccaggaagtctaacatagcctttgctccaccttaaaactcatccatccttctccttttgctgctttttatgaagtctgacactttccatctttgtattcccagcccagctctgccctgagggagggaaggcgaaggctgggtgtttagcttactttcaaactttgtatttccttttcttgtgtgtgtaatggggtcttgctatgttgcccagacctgctctggaactcctgagctcaagcagtcctcccacctcagcctcccaagctgaggactacaggtacatgatacccacccctggctgtattttcaaaaacagtgagtcagtgtctctagaatgaatagatatctgcccagaaatactcaactttgagtggggctttacaccagagacatccttcacgtaacaacccctaagtaaacaaactaaggtgtggagaggggatgtaaacattgctcatagcagcctcctacctaaaaacacacaagagagtggtggcaaagcattggtcttcactggtctttattgaatgagggttgtcaggagcaaaggtgggatcaagagcagcaaaagcagaaacaagtataaaagtatcaaaaaatacaaagtgctagcactgaggagagtgagaagggttgggttgtggcccagagggacctctgggacacaggattgaggacttgccacagcctccaagggaacctaggcctggggggcctgtgcaggatccttggctgagggtggaagtggcttgagcggggcccaaccctgggccctgaagtatgagaccagttgtgtgggcacttctgcgagcacggtctgtgccaatgcctcccgaggggcctgccaagaaaagggaaaagtcagtggtggcccagaacagctgcccaaagtctgtatttcatgctcaagaacccaaccatatcccaggcttagaggaaaaggtgagcatcccttgggcctcaaccctactcacatcagggaaaggtgaaagggtaaactcccagatcaaatttgcacctactcacattctggaaccggcggtagggtacaaactgcacaatgtcgcgggcagcagcctgcccagaacgtgtatgcaggggtccaccatcagcgtccagctgctccatggcctcaaagtcagcaccacccacacccacaatgatcactgacatgggcaggttcgaggcacgcaccacagcctcacgtgtggcttccacatccgtcacagcaccatcagtcagcagcaacagcatgaagtattgctggggacaagcccattcatgtcctgaagcagatcctcctcctaaacccctgcaaacaccccagccacacatccccacactcataagaagtcccttgttacaggccgggtgcgatggctcacacctgtaatcccagcactttgggaggctaaggcaggcggatcacttgaggtcaggagtttgtgaccaccccagccaacatggtgaaagcccgtctctactaaaaatataaaaattagctgggcatggtggcacacgcctgtaatccaagctactaggaaggctgaggcaggagaatcacttgaacccaggaggtgcaggttgcagtgagctgagatcgcgtcactgcactccagcctgggtgacagagcaagagtccatctcaaaaaaaaaaaaaaaaaaaaaagtcctttgttccataaccctcaaggaagcccttgattgccaccactgccactgccacccacgactctcaccgaggcagtcccctgatgtgcagcctgggctgcaaacctggccacatggttgatgatgggtgcaaagttggtagggccatagaggcgaacttggggcagggcttggcggtaggcatccacaatgccctggatgcctgcagaggagagcaagaaataccgtaaaatcctggacctctcaggactacaccagtcctgaaatcaccccatcccagcccaggagatctcggaacctgggtgcatttcattcattcacccttgtaaaccagggtacttaactgtctcctacacatgaggaaactaaggttcaaagagaggaggggacttgccctaaatcacagcttgaattagcacccagatgagagggattctcctggacaaatccaggagagtttgagcatcagattataacctatttaataatgatccatttgatacaataaggatccgtactatggattaattactgagggagaagggaaagctcctaataaatgtaaaaggaagaattacacaatcatttgacaatcacagaaatgactgattcaggcaaggatcatcaatggatgttaaaactagagagtatagccaggcacagtggcatgtgcctgtagtcccagctactcacgaggctgaggtgggaggactgcttgagcccaggggttcaaggccagcttaggcaacatagtgagacccccgtcacttaaaaaataaaaaaactaaggccgggcgcagtggctcaggcctgtaatcccagcactttgggaggctgaggcgggcggatcacaaggtcaggagattgagaccatcccagctaacacagtgaaaccccgtctctactaaaaatacaaaaaaaaaactagccgggcgtggtggtgggcgcctgtagtcccagctactcgggaggctgaggcaggagaatggcgtgaacccaggaggtggagcttgcagtgagccaagatcgcgccaccgcattccagcctgggtgacagagcaagactccatctcaaaaaataaaaaataaaaaataaattaaaaaaaaaaaaactagaggggaatgttgatgtgtgtgtgatgagtatttgtatagtctcttcccagaatatacttactaaatagaaaggagaaaatagtacttgtatagtggagaaacctggtagatcttaccttaactaagtgaccaaagtcaacatgactggtaataggacaaatcaacatcatgttcctctgaatatgatgcactgagaatatacagcatcactttggtggtattcctgccaaaaatgtacaacctgaatctaatcctgaggatttatcaggtaaacccaaactgagggacattctagaaaatatctggcctatactgtttatatcatgaaatgtgaatgtcatgaaaggcaagaagtcttccatataaaaagatatgtgctaactgaacgcaatgtgtgatctgagattttcttttgctgtaaaagacattaggacaattggcaacatctgaataaatgctataggctggataatagcatagatgttcatttcctgattttgaggattggtctgtgataatgtaagaaagagtctttgattttaggagatactgaagtactcagaggtaaaaagccaggtggataatgatgggtacaaagctggtagggccatagaagcaaacctgaggcagggctattcactacagcattctccaacacacgtatacatgtgtgtacatacataaacacatatttttaatcttttttcccttgaaatgtgtgaatgtgtgtgtatatgtatacatgtgtacacacacacacacatatacacacacatacacactgtatacatgtatgagaaaagagaaaacaaatgtggtaaaatgttatgttagggtaattgggataaaggtgaagagcccctgtgaactcaggccctgacccctgagttccaagggactgagctcctatgactattcttgcaacttttctctaagtctgaacttatgttgaaatacaaaattaaaattttaaaacccagatcagatcaggtcaggtcagattttccacttcagcttgtgcccccttgggggtactggggagtcaaaaggtttggccctaaacaaaagggcttggtggactctggcaaaatgcaccctgcaaggaggcaaacaaggcttccactgatgctcaagtaagtacctgttagcttctaggcaaagataataacgataatataacagataccatttttcggagaacacttagtaagtaccaggcttactgctttacttgtatcctctccttgagtactcaatttcctatgtttagtcttatgaaaccaaagcacacagagattaagcaacctgccccaagtcatgtggcatcatttttttttttttttgagataggttctcactctatcacccaggctggagtatagtggcatgatcatgatcatggctcaccacaacctcaacctcctgggctcaggtgatcctcccacctcagcctcctgagtagctagaactacaggcgcctgccatcatgctcggctaatttttgtaattttagtagagatggggttttgccatgtttcccaagctagtctcaaattcctgggctcaagcgatccacccaccttggcctcgcaactgagtgctaggattacgggcgtgagccaccactcctggcctggcatgacgatttgattccagaggcctagctctaaaatccaccctctgggtcaggcgctgtggctcaatacctgtaatcccagcactttgggaggccaaggcaggtcaatcacctgaggtcaggaattcgagaccaccctggccaacatggcaaaaccccgtctctactaaacatacaaaaattagccaggcacggtggcaagcgactgtagtcccagctacttgggaggctgaggcagaagaattgctcgaacccagtaggcagaggttgcaagtgagctaagattgcgccaccgcactccagcctgggtgacagagcaagactctttctcaaaaaataaattaaactaaaattaaataaaatccaccctctggacaatgaaggcaggtatctgcccccactctcccttttactcatgcaggcttgcccctctttgtgtggacagacctgcctcagggtggatggggaaacttacctgcacagtaggggttactggggttgaaattcaaggcaaattcatgcgagacctggagacaagaatgaaaatgaggttctttccccatgacctctgctaagaatgaaaaaggacactggcgtgtgccaagattcctataggagctatggagtcctgagcacttgctgtctacgtgcctgcaggaatccaaccctgcatctcctcttaaagctgagtgccaagtagcaagtaaatttaccacatcccccaaaatcaggaccctgaaactgaaaacaggagtggcagaaagagagggagctcacctgccagtcagggggaacctgggccccaaatccaaatgcagggaacagcttgtctctgtgggaggacagtgtattgggcaaaaggcagtgaggggactgtaagctcagaggctgaagcatctgcagggagcgggtatagcccagagaagcaggtactcacgagtcatagtcctgaaccacgctgcccacactccacagtgccatcaggtactcattgacccctgttggactcaggtagtgtagggagtcaggtgaggaggggtctccattggagccagtgaagtccacgcccacctgggaggaggtgaggaaggcagctaaaggccaccctgagccccagacctgttctcttgcccttggtaaagtaacttacagtgaagttgatctgacagcctcccatcacatagtccagaaaggagtactctgtttctacctgcaaatgaaaccagggtcatgcctggggtgatagcagttggtgtcatggagctcaggaatcagagccttggttacatgggcttttgtctcacccgacaaatcttgacacggatagttccagagttcttgtagcttttctttttctgctgcttctcagggtggatgcattcaaactcagcctggtgaggacagaaaaattagggtaggaaattctcagagcatcagtcaaggactcgagctgccttctccttcctctctcccacaagcttcagctatctaggcccatttccacacccctggcaagaccagcactcaccgggactgcctgcagctgggccaagctggtgtggaaggtaccgatgagatcatgtgacccgtcactgtcataatcggagcattgcacctgagggaaaggtgtgtgtggacataaacaagccaggtggcagatgagaataagtccctccccaggttctcttctccagcgcagtccacttagggggcaagctcctcacctggatgggtgtgctggggttcccaccacagaaatgctgaacggggactgagaaacgcttccatgtagggttcaggttgttcttgatgacctgaaggtggaggccaaggcctccagtgagctctggcatggccccctgaggagctgccacacttctctacccacctgcagtctctttctgagttccaaaccttgctagtcacaggccccaggagattatctcctaccccagcccacccaatcccaggggtctcatacctcagatctgtacaccaggtgccatttcccatcaccctggcggaagaactccagaaatggatctgattttcccaggaagtcctgccaatgcgagaccccagttacaagactcaggaacaaacaaccattatgccatccctctgtccacacccccatcccccatacaccatccttggccccttaactcttggattaccagggcctacttccagacacaccttcttatctaggtttctggcctctacctccatggttactacacgattgtcctttaattcctgagctgagacctaggtaggggagactacatcacctcatgaattcattgatgttaagtccctcctcaacccttgctgggttccttaccgtgatggtcccccgcccagcaggttttccaggcttcagcatcaaggggagagtcagtacctggctggacacaatctggggaaaagcagggaagggagtttcaggataacaggcagggttaggtcctgcttgccccctacctccaggcaggctaggttgtctcacagacctgcatctgaaggatcctaatccccagccctacatacctgtcctagggaacactcagcaccccctaggaagtcatcatccctcagctctggcgtcttgttgtctatgtcatagattccaaagcgtagcttctggactgtctcaaagcggtactcaagctgtagagtcttggagaactcagggcttgagcagttccgcacccgttcagtccggccaagctgtgggcagaggccagtaagcatcacagtcacagcctccaccccaaaacacaatcctagcctccctccacaaccttaacctccataatccgcctcacctcagcccagctgccccctcccacatcctgtaaaaggacgcagagtgggtcagacttggagccgatgtccttgtcaatgagatggtcacaggaaatggacagctgaaccaaggtcacgcagtgggccatctgagggaaaaggagctgggtcaagcaccagggagccttctctccccttccccgactacaggtcccagcttgggaaggccagcaggcatcacccaggcagggctgagcatacgtccacccccgtgacacccaaggaagagaaggcctcatagcctccaaacccctccacccctaggtgagctcactggcacagaagatggcagatacaaccaaccctggtctgaagatattgaaaaggggtactagcctccatctacaactgtgaccccaaactatcctcaccctaaaatttgtcttaatcccaatagggctgtccaaacccagactctaatcttggtctttgcaaagaccaataaatctttctgacccccttactggccccaggccagaccctaatccaagttctgatcctaacataaccccaaatataactatgatccagataatatcctccacaaattatcttcttccaataatttctcactaaccctggggatctaactcttgtggtggagttatgatccccctactaattctcctcacctctactgctaatgttcaactcctcactatttccactgctgctgcccaatctaagccatcactgtttgtcacctggcttacagcattagcctcttcaactggtctcccttattctatgctgtctccacctccgttcccccatgtccaccccaacaggctattctaaatacagcaatcagggcgatcctattaaaacataagtgaggccggacacagtggctcatgcctgtaatcctggcactttgggaggccaaggtgggcagatcacttgaggtcaggagtttgagaccagcctggccaacatggtgaaaccccgtctctactaaaaaaaaaaatacaaaaattagccaggcatgttggcgtgtgcctataatcctggctactcaggaggctgaggcaggagaattgcttgaacccaggaggtggaggttgcagtgagccgagactgtgccactgtactccagcctgggcaacaagagcaagattccgtctcaaaaaaaaaaaaaaaaaaaaggccggggacggtggctcaagcctgtaatcccagcaccttgggaggccaaggtgggtggatcacgaggtcaggagatcgagaccatcctggctaacatggtgagaccctgtctctactaaaaatacaaaaaattagccaggtgtggtggcgggcgcctgtagtcccagctactcgggaggctgaggcaggagaatggcgtgaatccgggaggcagagcttgcagtgagccgagatggcgccactgcactccagcctgggggaccgaggttgactctgtcacaaaaaaaaaaaaaaaaaagtgaggtcatatcacgcctctgcctgaaccctctagtacttcccatttcctactgagcttagaaaaactccaaacttggccagatatggtggctcacttgaggtcaggagttcgagaccagcctgaccaacatggtgaaaccctgtctctactaaaaataaaaaaaattagctggtatggtggtgggcgcctgtaatcctagcactttgggaggctgaggcaggagaatcgcttgaacctggcgggtggaggttgaagtaagccgagatcgcgccaccgtactccagcctgggcaacaaagctagactccatttccaaaaagaaaagaaaagaaaaaaagtccaaactataccatggcctataaggtcctggaaggtccagatttctttaacctgatctcggagtgtctctcttgctcactccatttcagccactttgtcactcctcaaataagccaagtttgtttgttccttctttcgtgagacagagtctcactgtcacccaggctgaagtgcagtggtgagatctcagctcaccacaacctctgccccttgggttcaagcgatccctcccacctcagcctcccaagtagctgggactacaggtgtgcatcaccacacccagctatttttttttttttttttttgtagagacagggtctcactatgttgcccaggctgctgggcaactcctcggatcaagcaatccacccacctcagcctcccaaagtcctggcatgatagtgtgtgccaccacacccagccagccaagtttgtttctaccccaaacactttgcagtacctggaatgtgttctttctctgcattatatccacatggctcactgctccctttccccacaagtctttactcaaaataatcttccctgttttatatatacatatatatataaaggctctcccttttagcccctctaaaatttcaaccccactgcccctggcattgcataccccttttttgctttttctcaatgtctaacattatatacatgtatatactgtttcccccactagaatataaattctgtgagaaaggaatatttagctgttctgtttattgctctatcccaagcacctagacaatacatatttgcagaatgaaatctgaaagttcatctccagccccagctccctgcccagccagctccaaactaactgatgtctcgcccttgtaatcaggcagcaccaagcttctctgattcaccccttccctctgctgggaacattattttcttgcatggttcaccacgacaacacctgggtaattccgtcctcctgcagccaccataacaatcaccctcagacctcttgttatccctgtgtcccccttggcccatatacctgaagaccactccaccagcagtgcacacgaggtcagatctttcactgagcttcactcagcattccatgtttcccaaagctataccctgagatgcctccagcgtcagccctcccctatactgatcctcagtcaatcgctcctccctcgcagcccacagcacctcatcttggtccctcatagtttccatctggaatgctgttatcaaagttggaatgcttcagagttcaacttgcttcacatactgcccctccacagcaccctggcccctgcatgaacagtcccagtgatagaaaacccagtcttacaatccaatcatcagaaagtctaggtccatacaaatcctacccaaactgacctaactctgtggaattcttacttctacctggtagttcttccccagcctagggctccatgggaaggccttaccctatctccctatgagaactcatctgatacctggaagctgtgaacagtcccagctgaaatctggagaaacagccgcagttcttttggctgttgcccctagaatgtggcctgcagacttctgaccatcctgatcactcccttgggggttccccaaggacagacccagagcagaatacatgctccctcaagggatcaggatcacagcttcccccaagtcacaatctgaactccatgcatgtcacctcacatgctctcccaggcagtgtttacacagtacagagacaaataaaaaagaatgctcatttcactaatgctgggaatagtgaaaaatctaaggcagcttaaaggtctatcaactaaatatgatacatctgaacaacggaatgctgaatagtggctaaaaaacaagccagaactatattatattggtatcctatgaaaaaatcaaaaataggccgggcgcagtggctcactgttgtaatcccagcgttttgggacgccgaggcaggcggatcacttgaggtcagttcaagaccagcgtggccaacgtggtgaaacccagtctctaccaaaaatacaaatatcagctgggtgtggtggtgcacacctgtagtcccagctactcgggagccaggagaatcacttgaacctgggagttggaggttgcagtgagccgagatcatggcactgtacacaagactccatctcaaataataataataataataggaagagtatgaccattttttacttcaattgtaaacttccattttaaacttcaattgtaggtgtatctttataacagatttgaatacaaacataaataaatacacacacagaaaaatagaagatgcatcaaatgttttaggtagctcaaaggagtggaagataagaattttgtgaactccataattctgtattgtttcaatattttatactgttttgtattttttaaaaggccttatatgaaataaaaaacaaaaacaaaacaagcaaaataaataaaaaggcctcatcagctttccccccaaatccacacctcaaatcttcttgactgttcattctaagcccaaagcctccacttccagttcaacaacccctacctaacttcaggccttattagtctcttgcgtcctgcttggtttctgtcctagcactgctccacctggtcatcccagatgccagcttccagtctctattccaagtaaaagccccgtatagctgcctttaggttcggagccaaactccctagcaaagctaccttgctgcacaactccaaaggacatacctacatagaatttggtagttttgcaatctggtaaccctgcatccctagatcaaccttcaaagctcttcccagtttgccatcagctctacctcctgccgctcactcacccacccaccgaactagtcatccaaagttatttctggttcatctaacacacatgcctgactttcctgcctagcaaatgtcctgtcatccatggttctaatatgacattattcctttatgaacccttgcctgttttccccaaggattttcttgtctctgctctggatgactgcgatgtttcctcattagtgtttctgcgaccatacacacacatttctgggtttattagccaaacagaaacctgatcatgtcatttttccactgaaaactctggaatgcctttccaaaacacttaagataaaacccaaagttcttaccatggtcttcaaggccctgcaagaccttacccttgcctaactaatcatctagccacgcaactatcctccagccaggttggcctttctgatccacatatacctaacaccaaccttatttaccacctcagggcttttgcactctgtctccctccttatacactacagaaaataagctatactagagtaggaactctggctagctccaggacccacagcagtatctatctatcctacagtagatactcatcagtaagtatttagtgactgacttaacattgaagccacaccataatttttacttttgtctgtctaccctgtaaactatggggtccttgaactagggctggatattatctctgtatcactagtattagtacttagtatatagctggtactaataaccatttgctgaacaaatggtgaatgtgcttttgctcaagtcacacttcaggccttgaactgatgtgtaacaataaatctcccctatcctgatcttgtatagttcaactttgaaatttaaatgcaggactcctacaactcaatattaaatgatagtcaattaaaatgggcaaaagatttgatcaggcacttcataaaggaaaatatgtgaatcagaaataagcaaagtgatccacagcgttaattatcagggaaatgaaaaataaaaccacaatgagatactgttacatacccaccacaatggctaaaagtataattaaaaagaccaccaccaccaaatgctggcaaggatatggaactctcatatattgttagtgaaagcattaaatgtaccactttggaaaacagtctggcagcttatcaaaaaacctaacaaacacctagcccaagagcgattccactcctacatttttagccaaaagaaatggaaacattatgtccacaaagatttgtataagaatgttcacagcagctttattcacaatagccaaaaacttgaaacagcccaggtattcatcaatatgagaaccaattgtgatgtttatagaaaactattcagcaacaaaaaaatctattagtatctgtaacatgaataaaaatgaagaataaagtaaacagattccatttatgaagtttcagaacaggcaaaacgaatctgtgatgtaaatattcagaacactggttgtcctcccttctcccccaggggaagggaaggtattaactgagcagaggcagagagctcccagtggaaagggaaacgttcttagcattctaagaatatgggtcacaggagtgtgtgcatttgccacttccatctaaaggaacactgagtgtacacatctgattgtaaaattttacaaaaaaaaaaaacaaaacccaacaacccataaacaaatgttgcactaaagttaaggcatgttgaaatgtttacaagtgtaccgatgactgaaacttttttgaaatccaccaaaaaataaaaggagttgttgaagaaatgtgataaaacaagattttaagttgtaggatctgaaatggcggatatatgggtataatttttttcaactttgctacatgttgaaaattttcataataaaatgttggggaaactattattttttttttagacagagtctcactctgttgcccaggctggagtgcaatggcaccatctcggctcatagtaacctccgcctcctgggttccagcgattctcccactacagcctccagagtagctgggattacaggcacctgccatcatgcccggctaattttcatatttttgtagagacagggtttcaccatgttggctaggctggtattgaactcctgacctgaggtgatccgcccgccttggcctcccaaagtgctgggattacaggcatgagccaccgcacccagctagggaaatttttaattggagaactacaggtcctccccctggtaagaggttgttgtgaatgacaaaagcattagcagtgattatttggggtggtaagattacaggccacaactggagctgctgtcttctcactccacgacttctcaaatgtccccaaaagagatgcccttggtctgggccaaacacgtgtagtgggctactattatcatcttcctgtgtaggcctcaatttctggtggactattccttcctaatcattaccattacaccacttttcctggactaaatcctttttcagttttttgaacccagaatcaaaccccagccatactgttgtgggctcatgtgtgcctcagtaggataaggggctgaactctcactgatgtgagcccctaaggtggcctggcttccattctgaggtcagagcttcctgtgcaagcagttttgttcacagatttgtctccttttctttctcattggaatcaactctttataaacaaatcttttccatctgtagttttctatcctttgagcaacatttcctttaaatgatctataaaccacgggattattaatctcttccaaaacatgtttaatctcctttgaaatctacctctaagcctatctctgcttagaaatctgtgattaaaactgttcatgtcactcttctgtcctacatctcttgaacaactacctactttaaaccagactcatgtatttttcatatactgccattataattaacgccatggactttcaacctcctttttaggaccaaaatcttccagaaccatattaaatatcacatttgagtcaataaaaaaaatttgtcatttatttttgtgatatttgtgcactctttcatcaccgagcacatcttggctcgatgtctctaacagtctaactggttttaccatttccactctcagtcccctcctatctgttatgttgaagtcacagacattccctgactctaatccaacaaaaccccaattcttataatcctatcaaaatgtgtaacttgcttattatgtatttctcctcttggactgtaacttcaacaagcagagggaccagattagtcttgcttctgtgccaacgcctggaacacagcaggtgctctactgatatctgttaaatttatgaatgctaggaaaggagtgatactcaaggatcctcagaaatgacccaaatctagctctgacctgctactgagacactgagagaagtaggctttctaggaacacccaacaccaaacaccaatttatcttctctgttaggtccccaccccctgacccttccatttgggactagtcgggtgttgcgaatggaacagctgagtctatagctccaacatttttctgcctctgctttctaccacttaggagttaccctttatagtttgttttcttctgtttactccctctgccaacctcaatgtgccctagcagggcacattctctcagtgtcccttaagaaaggcatactcattcccatttttataacttaaaattcacaaaatgtcagaaataaaaaagaactgagtggccatctaattcaagtccctcaatccaaggcatagagggaagatgtggtttggctaaggccacatatatggttaagtgaaatgaagactagaactcaaatattctgattcctacctaatctcaaaccttggactgttgttagacttttttcctctctttgaaaagcccccctttttatattgttgcaatctgatgcagtgggcaagagtgtgggttctgcagtgaagtgaccaggctccaaatactggccttattccttcctagccacaataatgacatactacaacactaaattgatgtcatatctatataacttgggcaaatacttaatctcactaaacttcaggttcctcaggtgtaaactgggggatagtatctatttctgaagattaatataaataatgtatgcatgatgcttagtacagaggctggaactgctatgaccacgtgttagctattatcgttatccttcaagcctagcttatatatgctccccttttcatgatctttccagcactcaacttctcactctggaccactatattcaattcatgccacacgactgtattctgtcgatgtttctccagcttcttgcctgtcaattaaatgacaaagctcttcagaataaacactgtttcagcatctcctgccacacagcatatacctgagcacataatgggaattcaaatacttgaggcaagtctgcagcagtgtgctggcgcaagcttgtatggcttgcaagagccaactgttacatatcaggaaatcgttgaagcaggtggccttggtaagtttaaaactgtagaaattgggcaactgcaaaaagtcatggcttccttcaccctgccagccagtttaccagcatactactgtcgatagggaatcccattctctgctacaagggagtaacttgcccttcattttctatggccacccttcccttgccttgggaggttctaattttcctattcataaccaagaacagatttctcctgggtccagtgggatctaattcagtgccaaatgagctgaaattcatttgtcagtccttaacacttccctcttccacttccaaagtcctaacccagaaaggcaccagcctgcaattcccaattccttatccaccccaggtaatgaccagaagttgtacagaggctgcaagaaggtggcatagagggctgaaggtctgggtggcagggccactcctttaataaaccaatgtcatgctcacactcctattgcctaccttggcatgctggatcagctcacagatgcaggatcaagtcttgaaagccaatcagaaaatcctccataggcttacaaaggaccacccatggaacattgtttcccgtaagactgaaaagacaaactacaccaaccaccaccactcttctttttcctttttggccccatcaaaggacatggagaaggtagacaagttttcttatccctacttttctaactcgaggattctccaaatttacatcagcagctctaaggatattcctcacaggtcacaaactgaaccaaaaatgaaaatcctttctataaaactacacattccttattcatacatatgactaagggctactgaatggtactcataaactgaaattttcaataaatttggtttagatccatatactactaaggagtcaggctgacacaaagtatttggcaacactacaaagcttaacatgtgcacacaaaaactaaaaggtgggaaaatatgaaaaagaagatggccacaaggttttccactttactgtactgggtgaaggtcaaaaacaaaaaaccaaagccactaatctaaccccaacatccccaaaggcttatccaaaagttgaacaaatctgaccactgtacaactaactcttcaaaaagaacctaacttgacgacaaaactggatatggagaaggaaagaagcaaactgaggaggactacatggtcttcaaaagcaggatagggccatctggctgtgacatctgtcaccccattgatcaccagggttgatttggctgatctggctgactaggtgggtgtccccttcctccctcaccgctccacatgcatctgtcccgaagctgcatgctcgattgaagacgaccatccctgagagaggaggactggtctttggtcaaggatatacgagtgctcccctgctagaacctgcaaacaggctctcaaaagcaggataggactgtagcggagtgggtgtttttctctgcccagagactctgaacacaccaacacaaagtcttcacgtgagtacttcaaaataagttcaggcagggtgcagtggctcacacctgtaatcccagcactttgggaggctggatcacctgaggtcaggagttcgagaccagcctggccaacatggtgaaaccctgtctctactaaaaatacaaaaattagccaggtgtggtggtgcacacctgtaatcccagctacttggcaggctgaggcaggagaattgcttgaacccaggaggcggagctgagatcacgccactgcactgcagcctaagcaacagagtgagactctgttgcgaaaacaaaaaaacaacaaagtaagttcaggtccccctctgcaatcataagcttgaccgtggaggccaagaagccctaccaataggtaagggccctccacactatagttggagttggcaaactgaaaaggctccttccccagcagctcagaatccatgacagaagactgctgccagtggcctcccactttccctaaaagtcagggaggggctggggatagttgagggagggtttctacctgaggagtcatacaagcatccatgattaaaacatctttgttttccccttactattaattatttttctctgcctggattaccccacctgtaaagtagggatgataatgttaactttacagtgttatttgtgaggattacatgaggacagtcatagaaagtatcccctgcccggcacagagtaagtacccagtgtcaactgtccctgtaggtgctcacaaacagggaagtgcacctttgggtccttctgcagtatcattaactccttcttggttaattggaccaaggaggagtggatccaggaggaatgcctctggtctacctgctccaggatataactagcaggacagggacagcccccaaaaggagagatgaagactcttcccctttgaatttctcaagctgcagtgtagaatcactaccacactagggaaaccaggagagcagtacccagatcaaaatttggagctccattcctggtcactttagtttaaggtccaaactcagtacagatttccagaaaccgaatggctaggttcatacaatcacagaagcttaaaactggacacaagcttatctaatttaatcccatactgtaaaagaaacactgaggccagagggaaataatctgtcctaagtcacataactgatggaaccacgaaccgattctgagaatgttatttctatatccaaccattttagcaacagttcacattttgtaattcaccccaatctgaaatctaccctgccactacaacagcagtgagactcacatggtctcccctcatgatctatgctaatgttagccttgcacaaacatggaatataattctccctatttgtctgactgctggggaaggaaggtaggaaatcctggactccacatttacaggagttgatcaaaggaataaattttaagtagcaagcatgcatagtgcaaataaggtagaactcacctctaaaaaatgtgatctgtatcaaaattttcaaaggacatctatagggtagtcaattctgcccccatccctcccggctgaaatctacattcttttaatgtctatcacctgtggggtgtctgagacaacagtactataccgccttcctgatgatctccaggactgaggcatcaccaaatacctgtgcatctacagtgtgcacaaaaggagtgtatatctcctacagcacaaaatgagatgagtaaatgaacaaaagcagaccagagctcttggaaaagaaacctacctattgttcataatgcaagccccttacccttcactggaataaattcatttgggacactggggagagtttaagatgggtcttcagaatttacatgttagggaagccgagaaagcaaaggaatatttcaacaacaggaaactacactatgacaaagactagtttacacttgttcctgtctaaccataacttagcaaatggccaggaaagccactacctggttcccgtggtataggaatgtacctagtataagcacaaccaagcacttagttgtgacttaaaaccctcaactgttgaagaacaggaaccttattttgcttttccaccaaagtataagtgctgggtgcacaccactgcaaaaatctgttagtatgagatacagctatggctaagctgtacattcatgtgaagttgtcttaaaagcttgaaggtgacaggtgcttccaattccaatctgtcaattcaatggtcatagaagtaaagcagctcatctacatcagtaattagtagttgcattaatgtccatcacttcagtcagagttacagcacagggaccctactggtcccacaggccaaaccacagaagggagttatgtataaaggctgggccactctccagcccccactgcaatctaatgtgtggagtatagtggagtgtggcattaacaaacttccaagtgggatcacagaaaaatcaaggcaatcagaggcactggtaccagttggtgtgatttaaaaccttttaagaaactgaggccaggcatagtggctcacacctgtaatcccagcactttgagaggccaaggcgggagcatcacttgagccccggagttcaagaccggcctgagccacatagtgaaactacccctccactccaccatcacccctaccccagcaattacctcatctctacaaaaaaattaaaaaaaaaaaaaaatagctacttaggaggctgaagcaggattgcttgagcccaggacatcgaggttacagtgagctgactgtaccactgcactccagcctgggcagcagagcaagaccatctcaaaaaaaaaaaaaaaaaaaaaaaaaagaaacaaaaaaactatttaaccctcttaaatccttcccactgtgtgacttgtggtgtagcacaatgtggttgttatcatttgatatgaagcacaaactctaagtgacaaggctttttttttttttttttgagacagggtcttgctatgttactcacgctagtctcaattcctgggctcaagcgatcctcccacctcggcctcccaaagtgctgggattacaggtgtgacccaccacacccagcctgacaagtcttatccaccaatcaaaagctatgaatgaactactcccacccattaggaggctgaggctagagacagcagtgaaggggcttcagtctaagagttttaagtcctggttacgagcaggtttactatataagcaagcaaagggaggaaatgaacagcagcagaatggaggtaatgaaccatcaagtagcccatttgaatacagtacagctcattcctaaaatgagttaaatacactcaacacctttgactgttcatactgaattatgttctcttgctgggcattgccccacaacgaaatagtcatctcctatcatgaaatggcaagccattaattaagcaaaatgacttgaaactagtaagttactaagatcaatatccagatgtctggaacaactggggagccaattccaatgctcagctgtgccatttaccacttctctatatgacgtttgctgagtctctatgccctaacctttaacattttaattaaaaaaaaatagggccgggcatggtggctcatgcctgtaatcccagcactttgggaggctgaggtgggtggatcacctgaggtcaggagttcgagaccagcctggccaacatggtgaaaccccatctctactaaaaatacaaaaaaaattagctgggcatggtggcagatgcccataatcccagctactcgggaggctgaggcaggagaatcgcttgaacccgggaggcggaggttgcagtgagctgagatcacgccatcgcactccagcctgggggacaagcgtgagactttgtctcaaaaaaaaaaaaaaaaaaaaaagagcgcttcacaaattgcgtgtcatccttgtagaggggccatgctaatcttctctgtttaattcgtttttaatatgtgctgctgaagcaagcacatcttaaacattttcactggaaggaggtccgtggggctattgacagaattcaagggatttggttgtgatttttcccagcactctttcctgcccttagactttcagagtgctgtccttctgtccctgggtctgaaatgtttatgtcaggtggctttttcctccttctggactccagtgatagagcagtatgtagagtagcaagccaccgtggctactcactgctagttaacgttgatccagaaaaggagtcatactctaggatgcttttgagactctaacacaaagcagccaaagcaccaagaataaacccaagaacagcatggtaaagaattaccatttaccagctgggcacggtggctcacgcctgtaatcccagcactttgggaggccgaggtgggcggatcatgagatcaggaggtggggactatgctggccaacatggcaaaaccccgtctctactaaaaatgaaaaaaaaaaaaaaaaaaattagctgggcttggcggcacgcacctatagtctcagctactgagaggctgaggcaggagaatcgcttgaacccaggaggtggaggttgcagtgagccgagatcgcaccactgcactccagcctgggcaacagatacagactccatctcaaaaaaaaaaaaaaattaccatttacctgagcaggagatgaacttgcttatgttgttgaatagacaggggttttcccagaaaagtcactgtaacatcagagaattgtgctactaccagagtacactctttccagaacatttcacaagtcaaaatgatcagattctatactaaaaagataagactgaaataaagccatttttaataaaaaaggaaagccataagtttgattctaccataccctgtaaaagctctacttttgggagattagtgatgatgcacatagttgataaactatttcttgctgtaaaacactggaaagcaggtaacaatgaattacataactgatctctcctgaacaagaaaaggagacatattatcacacagtccacccctttcagatggtaaaagccattttggatatctgtaggcagctgatttcactcagtgatttgtccattgcttagtcaaatcccgattatttaataatggctcagctactacctggaattatatgtctagccccctctaaaacacactgggtatccaaattctaatacaagctaaactctttcaagataaaaagttttcaacatttaagggctttgtttgccaacacatcatacacataaaattctgaaaaggtggatactatggacttgaatcaagtttcctccctgctgttccaagtatcctcttctcttgacacttcagcattagcaggcaaggataagcaacaatttttacctctccaagattaccaaatctacctctccaaaggcacaaaatattttcaggtttaaaaacaaaacaaaacaaaaaccctgacaagataatattatagctcagtaaagtacttttgtgcagttaaagcattaaaagcatcagcctgttttattttttgacaagtttattgaacagtattcaagacttcatctttataaacaaaaacctctgctgagtgatgccaaggcagtatttgctggcaatgttgtggccatattggcaacaagccattttgttgtgtttggtttctaaagtctggactactatagaactgccagtaaaacaatttaaatgtggcaattttgcaagggtggaaaataatttttaaagtgaccacttccagaaattctttccaaaagatttgactagcagcaattttacattttctttactcatttcccgagtgttcttaaaattgatgagattttacacttggcccatacctgtacacaaccacagactccagtaaaagggagctggaatttaaggctttcacgcatccttgtttttatgcaaggctgactatttccacctaaaaatgtaatgtttgcttacttccatacagtcctagattttcatccagtgggttaagactggccttaactacactgaatattactacctgaaattttaaataaagtttcctaatcgaattttcattgttgatgctttgacaacttggagtacaaagctaggaactacatttcacttaacactgtttcattttttaaaaagccactaataataattgtacatccaaactactgtgtaaacacagaacacacctccaaattatgcttgtgaactaaatgtttcactaaagttcagaaaagtttacaaatttgcttatttatgacatacatttgtagatttctctaatcctttaaatcaaaagaaaaatgaacaccaataaaaaaaaaatcagaagggagaggaaaaaaaattaaatctaatggaaaatattctcttccattaatgtcagagtcaccaaaaacagacaataaaatttacacataaaattgaaaatatcatgatagtgtttacaaatgcacacaactttgagcaaagctttacaaatccttcataccatacaaagcaaatgagaaaataatgtcaattcatttctaccccaaacctagttcttaggagaaaattcgcaggaagagaggtatgagtagtttcacagaatacattttcaagaattttttaaaaactgaaactccaatgcccagaacaagataaacagtatccttagcagttagcactgttaataaatctcagatacacaaaaatcaagttccagagggcaaagcatttaattacagtccacaacgagcactgttgtgattcatataaaacatagttctctccaatttctacacaaaccgctcttttaatttatttaattagatgaacaatgaaatcgttttccttttcagcatttatctaagatgtagaaataacaaagtagttgcaataaagtgtatgaaatatttaataagaatgtacgaacatataaccaaaataaattgtgaaaaaagataaaagactttcatcttcaaacaacccatttttctaaaatgaaaatagctttccaatggagaaaatatctgtggctgaaatacaactctcaagcagtgctgaagttttttgcattgtctttggaatgagaaatgattacttaacattaacttaaattaaacagcatatacaaacgttatattgcttttgaaattgaggaggcagtatctagtgatcggtcaaagcaaatctgtattcatgaattatcaaaagacccacaacatagtcacctcttgagtctaaacaatccttctcttaaacaaaaatcctgtactgtcaatcctctaagattgtagtgataaaaagccttttcaaatcttatcaaatgaaactgttgccactcttaaattacacaaccgctgtatttcagtgttccactgactcacaacaccaaaaaggcactgtatatatatatagtttaataggaaatacttattttaaaagactgacccctttgtaactacgctgatttgtaggaaatgttggggatgtttcaaacgaagacaaaggggccatgtaaaagataaaatttggttttcatgatctctcatctatctctccttctgtattgtttataatgtgacacattttcagagcattgactagggaaagtaaccataactagagccctgtaaggccaagtttttcatcacaaggaaagtaaccataattagagccttttatgacagtgagaaaatttgtttttcatatcatctcacctatctccccttccgtattgtttataatataatgtgacacatcttcagagcactgactagggaaatcataattagagccttgtaaggcaagtgttttcatgacaaggacacttaccaaccagaactcatgtggtcctcctgccttagtgtcctgaataccaaagaaaagagtatgaaagggtcaagaatctcaattttctcctctggcggctgcacttgtactctgtatgaagacttttagtaaacaggctcctgatcgaacaactatgccaaaaagcctccaaataacaggactaacacgtatcaatctacgaaccagcatacggatcttttattctatactactactgctaacaaagataatttcaacttcagttttaaaaacctagatataacactttcttatgaatgggcccctctttgtttaaaggccaaaatttcacataatcgggacaggaggaaattgatactacaattagtccatatgaaaaggacttcaaatcaagtatcttaaacacattattaaaagtggtttctggttttcgataccatccaaacaacatgaacaatttttaaactgactaacctaaatcgtggcggtcaaaccaaaaaggctctggtagataaaggactccatagtttatttttatggcaaaagtcttattccacacagttttaagtgtgacattagaaatcaaagtttgaggttatagcacaaacgaagtgtggacttttatatttagggaaaaaaaccaacaaaacagttctgctcatttacaaatgagtcaattagacaaacaaagcagcaacttctgaagcaggactgtctatacagcaaggacccttaagaagcaataaaggtacatacaatgaatctgtatacagaaattttattcaattttaaaagaaaatgaggactttagacaaagctttaccctataacaaagcaaatctgtccagctttaaaccaaattctgagagtagccaacttctattttcagcagctggcaagagcaccctcaatgagttctactgacatttctattttcttcatcccatatggtataaaacaaaaccaatctagactccttgataagctttatgtggtcatttgagttttacaaatggtttctctaatggtatgccaaaatcatttatgtgttctctccagatagctttactgtaacatacagcaatgtttatcctggtgagtgagtcttctgtaaacagtcaaccaatgctctatgttatggaaaccaagctatatgcaattgaaacaatccacaggttctaacctggaaatactaggaaaacaatctggatgcattaatcacagcaatatgaagatctaccctataaaaaatgatgtgaatggctaccctaatacaagttttacttttcttgaacctataggcctgtcatttaagtcaatgacagcagctgtggcttcatcccgagactcaaaggccaccatggcttcacctgtgggcatacctttttcattgtattttaaacacactgagcctgggattacttgatagccataaaagaaatctaaaatctcatcaatagacacagtaaagggcatgttttgcactttaattactgtcggtcctggttttccagaactagatgcaaagccagggggaccaccaatatggattgggccagggccggggccggggccggggccaggcccaaaagctggtggcccacccaaatgcccaggggcacttccaagaccaggagggccacttccaaaccccgggggaccgcctaagctaccagggccatttccaaaattctgagggccccctccaaatcccgatggcccacttaaattgtttggtccacctccaaaacccggaacatccagtcctagaccaggcaaaccactgtttccaactgaaggcataccaggcctagcatcaccaaaggccccgcctcctaatcctggaggagggattggtggcccaaaggcatttgatccaccaaaattaccaggaaagttaaatggaggcccattattggcttcctttgatcctacagtcaggaaggcatgctcttcacctcctgcactaggtattcctgcactgggcattcccgcaccaggcagtcctgcactggttattgctgaaccaggcagtcctgtgctgggcaggcctgcaccgggaagtcctgcactgggcagtcccacaccgggcagtcccgcattgggcattcctggaactgcaggattacctggcacaggcatctttaatcccttttttccttgggcagggggatttttctcaatctctctcatatcttctagggtaactacatgaacaaaagcttctctcccattaagttttttacggtgtaagcgttcagacttacgtgcatcatcttcatttttaaactgaaccaatgcctgtcctagaccttgcccattgttatcaacaagaacatgtacagcattttcatccactgggattccttctaggaactgaagaacatccatctttgtaatgctgaatggaatatttgttatgtgggcacagactttggcagagttgacatccccctctggatttagtatcatttccctctggtcatagctgaagttctgcagtctttttcgaatcatatctatcttttctagcatacctttcttagtaattggatgaacttgaataaagcgattgcccatgtactgtttatgacgacacagagcagccttatagtcagcctcatttctgaactctacaaagccttcgccagttgctttcccattgggtccataagctatataaatactatcttccacaatatccagctttttaaaaaaatcaatgacatgtttgttttctgcttcaaatggtagccctttcaagtaaacacaaaaaccagcctcatgtggtgatcttgaccttgatcttttctgcccactgggcgattttgacctgggaagtgtctgaggagggggatgagtttgtccagaaggtcccatattttgcttaaaagtgatatggcctccagcagctacccactgtctttctgtggcagggctaacttccacatagcgttgaatcatcagcattctgtttcgtttcaaagcttcaaatgtatcttgaggggagagaaacttaaccaatccattcccattatttcgacctacatgatctttcaacaaatgcactgcatcaacacggagcccatgaaaaaaatctctgacatcattttccattgcagaaaagggcattccatgcacactgacatacagatcatcagggttgatggggagtggcttcacactgctctgagagttcatctggatagggttaacaggattcaacggaccaagaaacataggattcagattattgttcaaattcataggtgctccagagccattcattccagcaggtagaggtgccacaggtggcggattcaagggcggcatgcccgacatgggtggcagtggggtcatgggtggcacagaaggaactgggggaatcgggggcacaggaggcacaggaggcaatgtaggtactggaggaggaactggaattgggggaatggatggcattggtggcagagatggcatcgctggaattggaggaattggtggcggcgggactgtgttcattggagaggctgtgcttggaacagttgagctaaacgttgggctcccaaaggaagcccccatatttggaggagctgttcctacgctggctgtggaaaatgtctgtatgtttttgttgctttcatgaacagaagtggtggcagtaactacactgggtgatggattattaaagttggatactgttgtgggcaagtttaccctgctactcattcctgagctaggtggtggtcctgatctactggcatttgctggtggtatatctaagttggcagtttcaaaacgcctacgactcagttcaatcatattctgcatttccgtcttactactcaacaatagtgttacttttgaccctttaattgtaccacctgtgcgcatcataccaagccttgcatcttcatcagtggcaaaaacgatgaaagcctcacccagttcaccccctacaatatgcacgcccccatcaggaatggtcaatccagagaagaagtggcgaatgtccatggtccccgccacaattgggagaccttgcaaacggatgaccacagccatgctgcgctgaaaccacacacacctgcagatgagaaaaggcaacggccaggtcagactcctgtttatcacaccaagtttttagctacaagaatgaccagctaccatattaggccctcaaatattccctcaagctatcacaggcaatgtctttaatttagatattctaaaaactgaacattacgtgccatttacaatgtaaaacgtagacaatttcaacttccagaaggcattaattttggaaacagttcagtcccaagactcaaaaagttcaagaaaaaacaactgtaggacagtaaaatacatatacatcattcagaccactaatcattcagtaagatttaaaagaaatgtctaagtcaaatcaggaaacaaagtttaacaatctatagggaaaaaacatgcaaagaatatatagaagttagtatttaaaactggcttagcatcttccctatatacttgataatttcatagaattatcaagagtgtgattttatagagctcagtctcaaaatccatccaacagaagcaaaaaactagaatactaatgaattgtaaataatacttaagactaaaagtagattcaagtcttaaatgagaactggttccattattttattcatcctaaaacttttcaatctgccttgtacattacaaaaaactacatatggaattatttattataaacaaggttaagacatactaagaagccaaaagaactactgaataggacagctaaaatctgagttaccttgattcattacccccaaaagtagaacctggttatagtcccattcactgtgactattttaattaaaactcaggtccaatgactcataaccaaatcctctatttaataaaattttttaaagtattattttcccctaggagagggctgacaataaaaatattttttgtttttgttttagaaccagagtgtgaattactcagtggttgttacagtcttggacctacacaactcctacaggatctctgtgatctccttagatcatgcctgttttgacataatcaaaaaagaaatgttcccctcaaatttcagtatttcagttccaaaggcttctaagagcaaattcaagggcagccctttggaaagtgacacaaaccgaattattgggcctgggaaacatactactttgaaattaaggtggtcaataacatagggtgttttccaacccatctgaaaagtcaacttttatttatttatttattttgagacagagtttcactcttgtagcccaggctgcagtgcaacggcacgatctcggttcacggcaacctccacctcccaggttcaagtaattctcctgcctcagcctcccaagtagctgggattacaggcatgcgccaccatgcctggctaagtgtttgtatttaggagagatgggatttcacctgacctcaggtgatccaccctcctcagtcttccaaagtgctgggattacaggcgtgagccactgcgccccacctgaaaagtcaacttttaaatataagcccataaaatcagctcatgaccctcagaaaggttataaattaatgaagagatttggttttatcacttctcaagaatattagaaggggcaagattttctactataagctctaagaattctgtaacttcattgtcaaatattatataaatactaatgcaacaaaatctgtaattatatctcaatattacaactgccgtatacaaacaagaaacaaactgcttggctttgacagttttctcacagacacatacacaaaaataaaaagccaccttcaaatttaatccagaaaaatggactagcaaacagaaaatgctttttgtgaggccattataaagcactagaaatttgggaagtgtggggaagcttttcatttacaaacttcaagagtcaacaagaaaaattaacgctaaaaaacatcacaccaacagtctcttttctcatttactatttagcagcctataaggaggttcatcaagcagtttccaagtcattaaatcaaattcacattccttgctcaatctagaatatgtggctgtatgcaaaatgtgatagcatttcctgttcaacttcaaaaaacggttaatcactttgtataggggaaacatcatgggcaatccaggtactcaaaacaacttgagagagagagagagactagtttgcactgggacaatcaaacagaaacttgatatagtcccaagaacacaaaaattaaacacagggctaaagtgacatacacagttaagtcttcaagccattttctgttaagagcagggatttactgaaagtttgtacaaggtacacatgagaatatgctattgaaaatctgcctcagattaccagctggaaagggctgaatattaaaccaaagtggaatacaagatttattcataaagccatctgatgagaaaaattgtttctagcttccaaaaaatatgaaataatatccgcagccaggtgcggtggctcacacctgtaaccccagcactttgggaggatgaggtgggtggatcacccgaggtcaggagttcaagaccagcctggccaacaaggtgaaaccccgtctctactaaaaacacaaaaaattagctgggcatggtggcaggtgcctgtaatcccagctactagggaggctgaggcagaagaatcacttgaacccgggaggcagagatcacgccactgcactccagcctgggcaacaagagcgaaactctgtctcaaaaagaaataaataaataaaacaaataaaaatttaaaaaaaaatttaaaaaagtatctgcttttctgttactaagtaactgtttgacagctaagtcatttcaacctaacttgggcctatcttagttacttaaacaagagggttagattccacttgctaaggttccatttaaagtctaaaatttgtactctaaaacatgtgacccattatctatacttaaactcttaggaaatataaataaacatatcaataacaagcatctgtatttgtaattagtctaaaatgctactaaggaataaaacttactgcctatcaggaaaatcacaagataaatagatccatataaatgaaattgacccccaaaggaacaactgttcaaagcacccatctaccccacccctatccctcagataaacttgtaaaaaaccacaccggcctgggtggcggctcatgcctgtaatcccagcactttgggaggctaaggcaggtggatcacaaggtcaggagttcaagaccagcctggccaagaggataaaaccccatctctactaaaaatacaaaaaaattagccgggtatggtggcaggcgcctgtaatcccagctattcgggaggctgaggcagagaagtgcttgaacccgggaggcggaggttgcagtgagccgagatggcaccactgcactccagcctgggcaacagagtctagcctgggcaactgagcaagactccgtctcaaaacaaaaaacaagcaaacaaaaacacacacacacacacacacacacacacacacacacaatatagttgctacatatattttcatatttcttaataagctatctcattttattttgtataaaaacgaactctctattcaaaatctcttacctgataaaacaagagatgaatttccttaacaagaagtagaggccaagtcaatcctgtgggcaaccaattaaaaccaacttttagactgcaatagagaataaacggaggcaaaaatcaatgcaggaaacacaaaacaacacgcacaggccacactgtacattacgaaggcgagtctgaaaccaccagagtacttcattagaatgcatatcaaaaaaaaaaaaaaaaagaaagacaccgtaacaaaatcccacacatgctttttagttggtattgctttcaaatttgagtatctcaaaataattatatatttacaagagtgtcattaacttagcccaataacgaatccactgaaaattaaaacagtcataaagctcagcttcacagctaattgctttgatcactttataattaaaccagtccagaaaactccgtaacacaagtctatttccccaggttctcaccaaatttgtgatgaaaaggcacaagttcgcacaataacaattcttggacaacttaagatagcaattcaagggtactcatggaaattactgcaattattctttcaatatattttattttgcacaaaatagcatccaacatcacaaaacaaatgaagtatgagttcttgctataaggactaattccactggagctcaaaatattaacaaaatattaagggaaagtgttttttcctctgacatcacaacagttctcaaaaacttgtaaaatttaaataaataaaataaaataaaatttaaaaacaccctaaaaatgcctgacatattaagagtatatcccaaaataaaaacaggtcactcatctttcactgtcatttcttccaaactggtgaggttattaacaagtcacaagcatatatgaccaaatgtctagacaactatattcaaaggtcattttttgctttttattttttttcaaaggtcatgttttaattcggagagagaagaaatttgccactgttcagtattaagattacctacgactacttttccaaatgatgctcatcttaaattagtatcttccaagaccaaaatacaactaatgaccttaatattcatcgccaaaaagtaaaacatatttcaaaaatctgtgtgattttctaaaggacaaactattcatcgtctagtcaactactcaagttgctaaagaatagtgagatggttttaccacaaaaagctatgcaaatatgtaatcaacacaatcaaaagtctagagcattgtattaatcttttacatgttgtagaaatctagcctcttttttttttctttttttgagacagggtatcgctctgtcgcccaggctagagtgcagtggcgcgatctaggctcattaggctcattgcaacctccgcctccctgggttcaagctattctcatgcctcagcctctggagtagctgggactgactacaggcttgcgccaccacccgcagcttatttttgtatttttagtagagacaggggtttcattatgttacccaggctggtctcttaactcctcacctcaagtgatccacccgcctcagcctcccaaagtgctgagattacaggtgtgagccaccacgcctggcctagcctaactaagtctaaggagtttaaaaattcttcatttgaaagccatatctagtagtttaacaggtcacaaaggaaaatgtgaaacagaaaaaaacctgcttcaagtaaagcaatgagcaagagcatgaagtactgtaatatttatgtacaggtttgactccagcagccacataacagggtaactttctagtttctagaacttgtaataaacatctgatccctactggagattccaattcaaaaggtcaggtatggggccagggcatatgcctgaatataaggtaagaaggttcctctcagcctcttcccttgcaaactcaaaagataccgtatgtctatcttgagaaggacatatctggggtcagccagttaagctcaaagggaactcaccaggtctactctcaaaaatttctaaaaggttaccagaaattacctttaaaaggaagatatttctcattccacaaggcaaggctgaaaggcccagctgaatttgacaaatgcctagttcaagttttatgtgtacaacttaaagcacaaaatcaatccagatagaaatttatgattctcttctatttcagcaaagaggaatacccaccccaccccataccaaggaaaaccatgcagaaagttgatgctacaagtcagaacttcacaacccttggtattatacctcttcaaaagggaaaggtaaatggaaatagaactgaaatacttctgtgttgacacctcactttgtaaaaaccacaagaatttaacataagtgtcactgttttccaggaaactactattcctgtattctaaatgtcagctagcgactgaatgcaggatttcaaaaatccacgccatttacctaaagctttgctgaactttagaaggataagactaaaataataactaaacaataaaacatctaaaatacatattctatctatacatacagcataatgataggaaaggagaaaatgggcctgatttgtcattaaagccactgatatacttcagaagatctaaaacaagaagctggctttagtatgttttccattcatattatcaggaattagtcctaacataaaggcttgcttcaacttgacaaaataccggatgcatgcacaaatcacaagtatctgctacaaaaatttaacatattatggcaagacagactttcgtatttactagccattctaatcacttggaatttcagaaaaaaatgtctgacaacaaatctcttcatcaagaagtcaaggcacaaactaaaacgactattttcactcttcatctggtagtaaacatccaaaagtgaactttaactttgttcagttatcactctttaatcaacaagaaccagggtacagcagagctaggttcttcagatccaaaagaaacaaactctcaaatgttcacctcagagattagcaacagagaaccaatcacaacgggcacaatgctaaaaacagtataatcacattataataaacattatgaaacaaccacagtttcagccacttgattttgttccccattcccaaatggaccatatatcaaagtctgggatcactcttaatgaaaaaattattctgacactgatggagatgtgtactttttataacgcattactcaatttttccattaacctccattccgtactcaaaggcagcaaatcagaagacatttctaaataagatattcctcctgtcaaaaatattaagttatgtttcaatccccccaaatgccaacaaaaatgttgctaccttcattttcacttcagagcaaaattatacttctaacctaaacaaccacattcactctgtttttgagtcttaaaagctggctttaaacttaattaaattttgtgcaaaccaaaaggtatatgggtgtggtagtaaaatctgataaaactgtagtttagataaaattatcttttctgtttagttgaaaacatttaacaatattcctttactccatgaacatttactattaagcacttgtgggccagacaaaagatataaaagtggacatcatcagtctctgcattttagggagggacatctaaaagcatcttttgtgcaaccaactactgacacttggttcttcctacaacatctacagaagaaaacatacattcatacaatgacagaatggctctctgcaaaatggagtaaaaactatcaacactgtcactggattccagcacctggaacacactggcccacaacatcaagtttcacacctaaagactgtactaacaactcccaaactctcaatactcaatcatcaaaacatttgacgtgtcaaagaaggtgaaagaagcccaaagagtactggtattagcatgtaacaatacgttgcaagtaaccacacaattatttctaaagcttcacatttttcatctaacagatttgaacataaagaaaatgaaaattatacattacaatccataagcaaagtaatcacatttaatcgagcatatataaaaatgtattccctgtttcattaaaaatctgtccaataatatatactaagcacatcttcattgttttgtataaacacgccaaacatttcactttcttcataaattaccataacgttatttgaaccacctgtaacagttcttcccaactttttatactctttgaaaatgtctgcacactttccactaaatccagaaatcctccattcttatcaaaactgccaaatttcaaaaacaagtacaaccagtcttgtattgtagttctataatttaaaaaacaagatttccctatgtgtccagacttgagggatttttctcgactgcaaatgctctgagatgcattaacaatatacactagttaacaaggtcccagacaattcttgttgctaagactgcattttgcaaaaattacaccatttcaaaccattcaagcaagaagctctaaaatactgcagtcacaagcctagcctctcccttcaacaaaccttcagttgccatcacacttttttccagtgggttatactgactctattattgaataatataaaacggtccctaccaacttcttcaatttatattaggttatctctgagaatcctggagccaaggagggttttagggcccagaaatctcttaaagtctgcaattctcagcatgacaccacgcagatgagtaaatgtttagcacttaatactgagtaaccctcacaagagcccctcagatttgtcactataaagcacacgttggaggcacacaaaaagcccgtacgtttacaacctagcagctaagcctgctgcactggcgtccaaccccgtcactaacctgtagatcctcaaagtccctcccaccacccaattcacgtggctgcaaactaatgcagccaagcttcagagaaactcaattaactctccatcaaaagcacccaccctccgcagcccactggatctcgtcctcctgaaatgccacaggatcctctcccgagggagccgtaaatgtgctgctcacagcagccccttccctactgggggaccaaaggcctggcatcttactacaattctcagagcctcaggaggcgtactcaccccaccccctcacctcctagcttcagacgccggcttctcaaaactgctacaccctcgagtaaagcccctccccagcaatggacctcggaggcatttcactgcaaacccctccaccttcaggccacgaaggcggccggttgtgacacttcctttctgaactcacaggagtgtaccgactacagcttcctccccacaggtgtgacctgggtccccttttgctggtaggccacaaaggcctcctttccatttcgggttgaaggagtgtcctcactacgattatctccccacctccaggcacagagatgtagttataacctctgcttcactgggggagacaagaaatcctccgtactcgggatgtaggcgtgtttttactgcagtccccgttagctcgcaggccgctgagccagccagctctggcctgccccctctcagaccacgggggagtcctcgctatggcctcgtccccacttcggtacgcaggctcatcctcttgcgtcctccttgcatcctctcagatctcagaggcctaagtggcatcccactccccctgcagccctgcctcgaccctttgtgtggggcgctagttgccgcgggctcgaaggcctccgaaggccccgccccgggccaccaaggggcaccacgagccccgcacagccccacccgttcaggggctgcgggagtcttaccggggaaagctgcgcggcaccagaacccagaccccgaattaccccccgcgcgagtgcctccgccccgcggccgacagccccagcccgaacggcttcccggagcccaacgcagccaccacctccttcgccgcttcacaaaatggccgtcggcccgctcagcggctccgcgttccagaagggggaggaacggcgtggttgacgtcaaggggccgcgcaagcgcgctgacggtctcgggcgatctcccggaagttactgggttttgtgctaagagggggatattcagtccctgcttgcgactgttggcgcacaggaccgaccttgggctagtggccctggcgggtgggctgggtatgagtgtctagcttggcccttcactgcaagactgtgcaaattgcttcacgtcttccagtttccgcggaaggagcgaattgtgcttacctctaagttttttgaggattaaatggaccacaacgtggtggctagttattatatcctgacaaaacagccaaaacctgattcttttttcccatttaagagtttatacaggccgggggccgggcgcggtggctcacgcctgtaatcccagcactttgggaggccgaggcgggcggatcacgaggtcgggagatcgagaccatcctggctaacacggtgaaaccccgtctcttctaaaaaatacaaaaaattagccgggcgtggtggcgggcacctgtagtcccagctactcgggaggctgaggcaggagaatagcgtgaacctgggaggcggagcttgcagtgagccgagattgcgccactgcactccggcctgggcgaaagagcaagactccatctcaaaaaaaaaaaaaaaaaaaaaaaaagtttatacaggccgagcgcggtggctcacgcctataatcccagcactttgggagtccgagaagggcggatcatgaggtcaggagttcgagaccggtctggccaacaaggcaaaacccagcctctactaaaaatacaaaaactagctgggtgtggtggcggtgcttgtggtcccagctacttgggaggctgaggcaggagaatcgcttgaacccgggaggtggaggttgcagtgagcccagatggcgccattgcactccaccctggatgacaaaagcgaaacttcgtctcagaaaaaaaaacaaaaaaagagttttaatctagggcagggcgcagtggctcacgcctgtaatcccagcattttgggaagccgaggcgggcggattacctgaggtcaggggttcaagaccagcatggccaacatggcgaaacctcgtctctactaaaaatacaaacattagctgggcgtgctggctggcgcctgtggtcccagctaccagggtggctgaggcaggagaatcgcctgaatccgggaggtggcggttacagtgagccaagataacgccatagcactccagcctaggcgacagagcaagattccgtctcaaaaaaaaaaaaaaaattaaatccatcgtgacccctccacggcttcactatagtattattttattatagaaaaagctattctctggctgggcgtggtggcttacgcctgtaatcccagcactttgggaagccgaggtgggaggatcacgaggtcaggggatggagaccatcaggagagcgagactacatctcaaaaaaaaaaaaaaagaaagctgttctcaagccgctttgggcctagccccccgaacttcatgcccctgctaattaaaagctggatgtggtggcttaagtctgtagtcctagctactcgggagttagaggcaggaggatcccttgagcccaggagtccgaggctgcagtgagctatgattgcatcactgcactttagctcaggtaacaagagcaagaccctatcacttaaaaaaaagaaaaaaaaggttgaaattatcacaattccaacaacctttcgggatttctatggcagactggactggtgctagcccagtatgccaaaaacagcaagttggaaaaccaggccacactgttaaactaaacctatgctttataggtttttataggtttgctctgtgtaggtaaaacatagtccattaaaaacaaaacctactaaatgcaatgtagcatccagggttggatcctggaacagaaaaaagacaggaaaactggtgaaagctgaataaaatctgaagtttaggccgggcatagtgcctcacacctgtaatcccagcattttgggaggccaagaggcaagaggattgcttcaagaccagcctgagcaacacaggcccagtctctataaaaaaatctttaataattttagaaaatcacgtttcattaatactaatataccaatgttaacctctaagttttgacaaatgtaccatagttttcttttgttgttttttttttttttttttgagacagagtctcactctgtcatctaggctggagtgcagtggcacaatctcagctaactgcaacctccacctccaggttcaagcaattctcctgcctcagcctcccaagtagctgggactacaggtgcgtgacaccacgcccggctaattttttgtatttttagtagagacgggggtttcaccgtgttagccaggatggtttccatctcctgacctcgtgatccacctccctccgcctcccaaagtgctgggattacaggcatgagccaccgcgcctggccttgttttttgagacggagtcttgctctgttgcttaggctggagtgtggtggcaccatcccggctcactgccacctcggctcactgctacttctgcctccagggttcaagctattcttgtgcctcagcctcccaagtggctgggattacaggcacccaccaccatgcccagctaatttttgtatttttagtagagacagggtttcgccatgttggccaggctggtctcaaactcctgacctcacgtgatctgcctacctcagcctcccaaagttctgggattacaggcatgagccacagcacccagcctattgttgtttttgagacagggtctcactctgtcgctcaggcttgaatacagtggtgcgatcaaggctcactgcaaccttgatctcacgggctgaagcgatcctcccacctcagcctcccaaatagcttggactacaggtgggcaccaccacgcctagataatttttgtatttttttgtagagtaaaggttttgccatgttgcccaggctagtcttgaattcctgagctcaagcaatccatccaccttcgcctcccaaagtactgggattacaggtgtgacccaccacacccagccaaattagcatagttttatgtaagactttttaattagaggaaaactggtaatagatctacaactctactatctttgcaacttttcagtaaatctaaaattattctaagtaaaaaagatatttttcaacaagaaaaattctataatttcatctcctccttccactgtccatctacatttaccaaactttagcccagtggctttcaaactttcctgtccccctgctactggcaagtatgaaaagcaattaaacttttttgaccattatccacaataagaaatacatttataacctggtatacaaattcaaatatatcatcaaaatatattcttaaaatatgcataaatgtactctaacatactatctccttttttaagtactggtaactacccacctatgggttcagacccacaaatgaaaagctctagttacaatggccttctcttggtttctaaagtataatactttgtgctttatcacacttcaggcccttagctcttgccattccttctcacctctcatttctagattagcgagctcttcatatttataagcactacctcctcagaaaaactttcctcaaacacccagcatggtaggttttccctgctatgtcctcttaccacttaattctttcatagcacttatcacaatctataacattgtttatttgtttaattattttccatctctccactaaaatttaaaactcagtgagggcagggtcttttttggtcctgttaaccagtgtattcctaatacccagaacaaatctggctcctggcaggcattcaaataattcttaaatgaagagatacaaaagcccactgagtcatttatgcaaatcagatggagtggcggtcttctccacaattcccaagtacagcttccacttttccctcaacctctcataaagtcacagagtaaatagaaggtgagtttatttctccagtcttgaaattaacaattttcaagaaaacaaattattagaataactggtggagtcacagacatatttctagctccattaggtcaaaggaaaggaaagaggacaagggtagaaaggagacaagccctctaagaaactgtccattcagtctgtctgcagtcaatatgaagagatagcctttggagctacagaaaatattacattgaagtggattatgcttgctgttaaagaagctggtccagccgagcagcagcagaagacgaagactcaaatgtccatgtagagcatcatggtccctgaccaaagagacttcttctggttcctcttgctctcctcaccaagagcacagatgtgcccagcagcaatatgacagcaaatgtctctatggcttcgggatgaaaatgtccacacactttaagacccgagaagaaatggggagtgctccacacccaaggaactgaagctagggaaagacagttttcttgtgtttctgtcatagaggtggactgatgctgaagtcaactggtctataccaatctagagcatccactaggtgtaacaaggtgtctggttgtgcacgggttggtgaggcaggaggggccagaccagcacaaagtcagggccctattcttctagtgttgggtccacttgatgctcttgaggtcaatgccatcctgaaccatctcccagagagggctgccaaagagaagaggcattaaatgagtgagggcttagataggaagtcgacaacattggccccaaggctctgagcaatggcttgcctccttctgtccctgtctgtcctctgcctcttgccctggtagaccctaacacaggtggttaaggtatcctgagctctccagctccctgtaagtccttgtcagctctcctgagagctctccccaactgctaacaggaataactaggttcctcaggctcaattgcagtggggccctgagccaatggacaccaaacatggtcatattcttgaagctttcatcccactggtaagaggctatggccatggtttcccttggaggaaccaagacccttgagacttgtataaacatctagtttaagcctctcttcatatgacatgtataagcagctcgtttcagcccaccacatattacccgcttttcagcatttgtttcttggttttgttctagttcccagttaggggtggaacttaaccctacatcatcttggtatgctgtacccttacccagttcttgcccgtttcatctccccagagttggcctgtgcttccaatatccctgggtctaatccaaaagaattccttggatcttagacctgagcatcccatctcacacaagagctgctgctaagaaatctctgctaagctctgatcgatccccaagcagaagcttggatatcttggataatgttcccagaccagatattacttcagtgtgctatgaatatgggattttacagtttagatttcaccaggtaattttatcaaatttcattatattcttgacttgtccctcttctatatactaaacattcccagaatgcctttctattcatgagattttccatggcccttaaagttagccatctccttcctgtccttcctctttagggaagaccacttattattataggctcacaaaataagactctgagagctaataggaccaggctgcattcagtttgtaaagggtcagaaggaatagggtgcagatgccgaagccacatagataggaaacaaaaggctttgctggccacgtggtcagtagaaatgccttgtgagtataccacagaataccagaaagtgaggacaaaggaagggtcctgcagttgagcaagctatagacacttaagcaatacagctagaccctacaaagaaaaatccagaacacagaaaggcctgggagagctcataaagggaagcagagtatatacctgaaattcctctctctaccaactagatcaagagaatcctgaaagtcaaggttaaccaagacagagccaggctctgaaaaaatctagaggcctcaaggttccaggaggaagatgagctctgtggctactaggggaagccctggtgccagctgactggccaaggatctcattacctttataaacacattgattgattgattgagacagagtcttgctctgtcgcccaggctggagagcagtggtgcgatctcagctcactgcaagctctgcctcctgggttcacgccattctcctgcctcagcctcccaagtaactgggactacaggtgcccaccatgccaggctaatttttttgtattcttagtagagacggggtttcattgtgttagccaggatggtcttgatctcctgacctcatgatccgctcacctcggcctcccgaagtgctgggattacaggcgtgagccaccgtgcccagccacagaaaatatatttttaaaattagctaggtgtgggggcacacagctgtagtcctagctacttgggagtctgaagcaggaggataacttgagcccaagagtccaaagttacagtgaactacaactgtgccactgcactccagcctgggtgacagaatgagacactttctctaaagataataataatcataatgaacaatactacctgggccaggtgcggtggcttgtgcctgtaatcccagcactttgggaggccaagacaggaggactgcttgagcccgggagtttgagaccagcctgggcaacatagcaaaactccgtctctacaaaaaatacaaaaactaaccaggcatagtggcacatgcctgtagtaccagctacttgggaggctgaggtgggaggatcacttgagcttgggaggcacaagttgcagtgaggtgtgattgtgccactgcactccagcctgaataacagagcaagaacttgtctccaaaaaaaaaaaaaaaactactacctgcattacctgcattcatctagttctttagtttgttgtttttgtttttgtttttgttttcttgagacggagtctcactctgtcacccaggctggagtgcagtggtgtgatctcggctcactgcaagctccacctcccaggttcacgccattctcctgcctcacctcccgagtagctgggactacaggtgcccgccaccacgcccagctaatttttttgtatttttaggagagacggggtttcaacgtgttagccaggatggtctcgatctcctgaccttgtgatccacccacctcagcctcccagagtgctgggattacaggtgtgagccactgtgcccggcttttttttttgggacggagtttggctcttgttgctcaggctgcaatgcaatggtacaatcttggctcaacgcaacctccccctcccaggttgaagtgattctcctgcctcagtctcccaagtagctgggattatagggatgcgccaccactcccggctaatttttttgtattttagtagagacggggtttctccatgttggtcaggctggtctcgaacttctgacctcaggtgatctgtccgcctcggcttcccaaagtgctaggattacaggcatgggccaccctgcccggcctagttctttagtttttaaaaacactttctcattgtgaagacaagtagccaagaagatctactttcttgctttgtggaatctctaaatcctaagatccaagtacgcttgaactttggttttggcagtgtaaacacatagcctaaggacaagaggggagacagtgctagagtttcttccaaagcgtctctgatacaatatgtatacctcatttctcgaagacgcttcacatgctgaatgcatttctccactgtgtagtccacttcctcctctgtagtgaagcggccaattccaaacctgaaaaaaggcacaggagaatggctccccatcagagctctggcactgggataaattcattccgcaaatactcactaaggatctacgacacaaaagatatggagagaagaacatggtccttcccctttaggcagagtttctcagaacatggtatatggatcggccgggcatggtggctcacgcctgtaattccaacagtttgggaggccaaggtggacagatcacatgaggttgggagttcgagaccagcctggccaacatggtgaaaccccgtctctactaaaaatataaaaattagctgggcctggtggcacatgtctgtaatcccagctactcaggaggctgaggcaggagaattgcttgaacctgcaagtcagaggcttcagtgagctgagatcatgccactgcactccagcctgggcgacagagtaagactctgtctcagaaaaaaaaaaaagaacatgatctacggaccaccaacattaaaatcacctgagatgttttctactcctcctccggacctagtgaatcagaatatctgaatgtgggactcagatatcatatttcacaaacttcccaggtgatactcaatgaagtctgagaaccactgctctagaaactttcacaaggttatgagaagagataaggagaactcgactgagaaaaacttcagggtggaaaaagaaaaaaactgtaacaggagatgaaaaatataagaggatgcctttcataaatgttgcagctcaactcactgacctgatagaagagtgcgctaaatcctcatcagtgccaattgctctaagcacataagagggctccagggatgcagaggtgcaggcactgaggagagagacacgaaccttgttcagttcatcatcaacgtctacttttagtcacaaaccctcagtcttgttcccatcccccagggccctggagtcataccctggagaaaacaagagaccttctaatctggcagaactaaaggacctgatgctcccctgcacatcctaggatgtgtgaacctagctcctctggcccccatggtggatgacttccttaagcaaggacgctggcaaagtgtgacagagcatgataccacatgggtttgacaagaagacgcagcagaggaccatgtgctcacttccccaggacgtaatgcaccatctgcaccagcctgaagggcagccaaacacttagtggcctttggagcatcttcaattctagaggcctgtaacagaactgctagtgtaacccacaacagacacatacatcccctgggacgataaaaggcacaaaattctaccccaggaagtcttcctagggtggtaaacttcagtctgtacccagctacccagccaaccaaaaaaagagaggcacttacaaaatgacctttacccttaatcaagaggtcttgtgcctatcatctccacactgggaagtttaatagcctgtatgactcttctaagtggccctgccgcaggccctgtctatgccgtccagctcacctccctgaggataaggcaacgtccttcagtgccatcagcagactttccccttccacatatgcaaaggagaggttgatacagcctggaggaaagaaatactgtgagagaggtctcagagtctcagcctctaccagaatgaggatagaaagagcaagtccataccgggataatggtgcttagggtccccattcatcaccacatctggaaggctcttcattatattctgtatcagccgctctgacaactttgagattcgcttgtggtcatactaaggagcaggcaaggaaggattaggcagtaaccattaaccagctcagaaagacagtttgagaagcccttctcctataactggaagtgactatgtatcagccccacctatcatcctatgtactcatggggaccactgtatctccagtactgagcatagtgcctggtatgcaaaaggcgcttgataactggacacagggttcatttacttatccagaaataaatgagctgataactactaaaaggccatgggttttgaagcccataatgtctccctcagaacaaggtgccagcagcaccaggacaaggaagagttttcttaagccctctctccctgcagagatctgcctcagtcatgctgagaagcctctaaataggagacccagcacaggggaagaagttgtgggagggaactgctctccccatacctccatctcttgctgtgccacctcacacgcagcccccagccccaccactaagggtgtgggcactgtcccagaccgcataccccgctcctgcccccctccactctgcagggcctccacacgcacacggggccggcgacggatgtagatggcaccaacccctgggaaacaaaatttgttacaaaaaacagaaagagagaaaagtagataaaacaaaatatttctttccaaagggatcaaaatattacttcaacttttctgtaagcatgaaatttttctaaataaaaaacgttaaggaaaagaagaaacagcagtaaaagcatagtatttagtaaaatatttaacatctggaagataaatgccagaaggagtaatgatcaaaatggtttaaagtagctccctatgctatatgaaatgccatcatacattacagtattattcataatagcaaaaatactgggaacaacttagatgtccatcatcagggtaatggtcaaatagattatggcatgtccatacaatgaaataccaagcaggtgtataaaagaatgagggggccgggtgtggtggttcacgcctataatcccaactgtgggaggtcaaggcgggcggatcacctgagatcagaagttagaaaccagcctggtcaacatggtgaaaccctctctctactaaaaatacaaagattagccaagcgtggtagcaggcacatgtaatcccagctactcaggaggctgagacatgagatgaacccaggtggtagaggttgcagtgagctgagatcaagccactgcactccagcctgagtgatggagcaagactctgtctcccaaaaaaaaaaaaaaaaaaaagaagaagcttgttctgaactgacaccataaaatctccaagatacattgttacaaaactggtgaaatccaaaaaaaagtctgtactttagcttgaaaaaacaaagatgtattggccgggcgcagtggctcacgcctgtaataccagcactttgggaggctgaggtgggtggatcacctgagttcgggagtttgagaccagcctgaccaacatggagaaaccccttctccactaaaaatacaaaattagccaggcatggtggcacatgcctgtaatcccagctactagggaggctgaggcagaagaattgcttgaactcgggaagcagaggttgcagtgagctgagatggcaccattgcactccagcctgggcaacaagagcaaaactccgtctaaaaaaaaaaaatgtattatgggctggacacggtggctcacacctgtaatcccagtgctttgggcagccgaggcggacagatcatgaaatcaggagttcgagaccagcctgaccaacatggtgaaaccccgtaattattaaaaatacaaaaattagctgggcgtggtggcacgcacctgtaatcccagctactcaggaggctgaggcaggagaatcgcctgaacttgggagccacaggttgcagtgagccaagattgtgccactgcactccagcctagtgacagagcaagactctgtctaaaaaaaaaaagatgtaccattaggtgaaaaatgaaagattgaaacagtgagtacagtatgctatcatctggataaaaaagaaagctggaggagaagtatatatttgtttgtaaacacataggataattgtagaaaaacccaagaaattgcctcccaataaccagagaaaatcagaaaaaaaaaaaaaaaaaaaaaaaaaaaccaagaaagaaattacctccccagaagggaactgcatagctggaggtcagaggtgagaggcagacttttgtctgtgccttttttttccctttttttttgagacaagagtcttgctctgttgcccagactggagtgcaatggcacggtctcagctcaccgcaacctccaccttcccggttaaagtgattcacctgcctcagcctcctgattagctgggattacaggcacccgccaccacgcatggctaatttttgtatttttagtacagacggggtttcaccatgttggacaggctggtctcaaattcctggcctcatgatctgcccgcctcggcctcccaaagtgctgcaattacaggcgtgtgccactgcacctggctgtctgtgcacttttttgtagcttttgaattttgaatcacatgaatattactttttcaaaataaaatttaaatttaaaaacaatttggtggagcacggtggctcatgactacaatcccagcattctgggaggccaaggaaggagaatcacttgagaccagaagtttgggaccagcctgagaaacacagtgagaccccgtgtctacaaaaaaaaaaattaaaacttagctgggcatggtggcatgcacttatagtcccagctactctggaggctaaggcaggaggatcacttgagcctaggaggtcgaggctgcagtgagctatgatcgtgccactcactccactccaggctgggcaacagactgagaccttgactcaaaaaaacaaaaaacttaaaaatgcgtataacctgtgactaaacaagccgaattacagaaattttgtgccaaaatatgagcatgagcatgcaaagttattcaccaagtaatcagggcttctgaatagaattggcacttgacagttctcccacacagaaaaactgtttatgctgagaatggaggtactataaaaattaaggcagtggtttccaaatcgattatgaaggacaccagattttaaataataagctgggtgcagtgggtcatgcctgtaatcccagcactttgggagactgaggcgggagggttgcttgaggtcaggaattcaagcctgagtaacatagtgaaacctctatctctacaaaaactgttttaaaaattagccaggcattgggccgggcacgggattacgcctgtaattccggcactttgggaggccaagggtgggtggatcacctgaggtcaggagttcgagaccagcctggccaacatagtgaaaccctgtctctactaaaaatacaaaaattaggccgggtgtggtggctcacacctgtattcccagcaccttgggaggccgaggcgggcagatcatgaggtcaggagatcaaaaccatcctggctaacacagtgaaaccccgtctctacaaaaatacaaaaaaaaaaaaattagccgggcgtggtggcaagcgcctgtagtcccagctgcttgggacgctgaggcaggagaatgtcgtgaaccctggaggcggagcttgcagtgagccaagatcacgccactgtactccaggctgggtgacagagcgagactccgtctcaaaaaataaaataaaatacaaaaattagccaggcgtggtggcaggcacctgtaatcccagctacttgggaggctgaggcaggagaatcgcttgaacccgggaggcggaggttgcagtgagccgagatctcaccattgcactccagcctgggggacaagagcgagactttgtctcaaaaaaaaaaaaaaaaaaaattagccaggcatggccgggcacagtgggcctataatcccagctactcaggaggatgagagaggagaatcccttcaacctgggaggcagaggttgcagcgagccgagatcacaccactgcactccagcctgggcgtcagagtaagactttgtctcaaaaaaaaaaattaggcgtgttggtgcacacctgtagtgctagttactggtgaggctggggtaggagggttgcttgagcccaggagattgaagctgtggcaaggtaggatagcaccactgcactccagcctgagcaacagagtgagaccttgtccctataaaacaaatgaataaaataatgtattaaactgtatttattaagaattatttcatttctccatttaaaaaaattcaagaatcttatactatctgagtctaaacagttcccaaattcaaacagcaagtgctcaaataccatgtctgaacagtgaagaatgccacattatctaaatctatttagattctggacttggaaagcaggaggttggataatgagggacacctgtacacatgtaagtgttgatcagagcttctgatcaatgagttcattggttttttgtttttaaaatttttgtgagtacacaggaggtatatatattatggagttcatgagattttttttgtttttgagagggagtctcgcctgtcgcccaggcagtggtgtgatctcggctcactgcaacctctggctcctgggttcaaacgattctcctgcctcagtctcctgagtagctgggattaaaggcacatgccaccacacccggctaatttttttatttttagtagagacgggggttcaccatgttgatcaggctggtcttgaactcctgacctcgtgatccgcccgccttggcttcccaaagtgctgggattacaggtgtaagccaccgtgcccagcccatgagatgttttaatacaggcatataatgtgaaataggcacatgatgaagaatggggtatccagcctgagttcattggtttttatcaaaaagacttatctacaataaaagccaataaaagcaacattttattaaaagacagaacgcttactgggctttttgaaataataactcacaaaaaacactctacaacctctgggaacccttagaagacgccatcttccataattccagaagctattacacctacttccacaaggtatacacccagataacacaccctgcagacataaaaagggtaccagcacagacatcaacccaaaaaaggccctcacttgagaaagaggagttatattttatatttatattttatggttaccttcacaaaacagaggacaacagtctattcccaagggttaagggaaagaggcataactcaagcttgaacacattccaataggaccatagggaacaaacatgtatccttgagagactaacaggataacagactatgaagtcttctaagaataaacacaaagatagctgggcttggtggctcacatctataatcccagcactttgggaggccgagacgggcggatcacgaggtcaggagatcaagaccatcctggctaacatggtgaaaccccgtctctactaaaaatacaaaaaaattagccgggcgtagtggcaggcgcctgtagtcccagctactcggcaggctgaggcagaagaatggcgtgaaccagggaggtggagcttgcagtgaaccgagatggcgccactgcactccagcctgggcgactgagcgagactccgtctcaagaaaaaaaaaaagaacacaaagagatgtcaaatcccatgcaatcttcccctgagctatagcaagacactgggaatgagggactcaaatagttgctctgcacatcatagtggggaaaacaagatagctgggcctatctagataaatttgatttgacaaaacccatttttcctcaaccaaattaagatctacatgcttgctaaggatttgttaaagagagcaagaaagaatggcctgatgtatagtaactgctaaggtctacaaacaagcaagtgtttctggctattgctaaatgacatttgcattctacaagggactctgaatgtacaacttcctctgagagcaacagtagtcccaaatgactgtgacaaacatctatcaaaggtcttgctggaaggtacagagagaaggaactctagaaggggctggtacctttgggaccgtagattttgtgaccactaatgctcatgagatcaattttcatgtcattgacatcaagtgggatttttccaacagcctgggctgcatcagtatggaaatatacctttctggaactgcaaatccgccctgaggaaacagaggggaagacccacagcacaatgttggaaagtcatctgtcagagtcccacagtgcactgtgaattatctccaatagtaaatgacctgtaaatattaaactcctcccctccctccttctaccccttctccttcctcttttccttccctcctcccccttcccccttcctccctctctgtgtctcagtagcttcccttctttagaataaaaaagatgaagggcaaagcaccagatcgaaacactcgtgatattcttatgcatacaattctcaccacctcattaacaccagcctttcaaaatgtcagattactttctagatcccttttgattaaaaaacaaacaaaacaaaataaaaaaaaaaaaacaagattaacagatctttgtgctaatgtgcctaaagaaattacagggcgatctctatgtggggagaatagagatgttctaaaaggaaaaagagtagcaggcttttttgttttgtggttggttttggcagcaactgcaataaaattaaaaaccataaaaggtgctagacctggccgggagcagtggctcacgcctgtaatcccagcactttgggaggccaaggcagacggatcacctgaggttaggagttcaagaccagcctggccaacatggcaaaacctcatctctactaaaaatacaaaaattagccaggcatagtggtacacacctgtagtcccagctactcaagaggctgaggcggtaggatcatttgaacccagagtgaggaggttgcagggagctgagatcacaccactgcactccagcctaggtgacagagtgatactctgtctcaatgaaaaaaaaaatggtaatagacctggattcaaatactgcctatgacacttccaatgtccttgaacaaagtacttaggctttcccttgatttcctaactacactccatagagtattacagctctcagtatactacctcatacagagccccatggtgggcagggatcagggataagccatgatactcacctatttctgcaataggctgcttcactccaatctcattgttcacagtcatgactgacaccaggctagtatctggctggatagcagcctctagttcctagggatatgcaggagtaaggtgactagatagtacaaacaaagtcctcctaaatcagaatataggcaaacttagtcatgaaaaggagtcttatactacatacctatctgaatagttaactaaaaacagtgacaacacaaaatgttggtgaggatgcacagactctgaatggttcatacattgttagtgggaatgtaaatatcacagccactttggaaaacagtttgacagtttctgtttctcatcaaactaaacatgaaattaccatagaacccagtaactgtacacttgggcatttatcccagagaaatgaaaattaaattcacaaaacatcttacacaaatgttcacaataactttattcgtaataccaaaaacctagaaactacccagattccttcaacagacgattttcgtacatccataacatggactactacttatcaatcaaaaggaacaaactactggcacacgcagcagtgaatgaattcccaaagacttatgattagtgaaaaaagccaataaaggccgggcgcaatggctcacgcctgtaatcccagcactttgggaggctgaggttggtgggtgtcctgagatcggaagttcgagaccagcctggcgaacaaggagaaaccctgtctctactaaaaatacaaaaattagctgggcctggtggcacacacctgtagccccagccacttcggaggttgaggcaggagaaatgcttaaatccaggttgcagtaagctgagattgcaccactgcaatccagcctgggtgacagagtgagactctgcctcaaaaaaaaaaaaagaaaggccaggtatggtggctcacgcctgtaatcccagcactttgggaggctgaggcaggcggatcgcaaggtcaggagatcaagaccatcctggctaacacagtgaaaccctgtctctactaaaaatacaaaaaattagctgggtgtggtggcaggcaccggtagtcccagctacttgggagactgaggcaggggaatggcgtgaacctgggaggcggagcttgcagtgagcggagatcacaccactgcactccagcctgggcaacagaacaagattccatctcaaaaaacaaaacaaaacaaaacaaaaaaacaaaaacaaaaataaaaaagccaatcccagaaggttacatactgtatgattccatccacatgacagtatgaaatgacaaaattaaagaaactgccagccgggtgtggtggctcacgaatgtaatcccaggactttgggaggcggaggcgggtggatcagaaggtcagaagttcaagaccagcctggccaagatggtgaaaccccgtctctactaaaaatacaaaaattagccgggcgcagtggcaggcacctgtaatcccagctacttgagaggctgaggcaggagaatcgcttgaacccggggggcagaggttgcagtgagctgagatcaagccactgcactccagcctgggcaacagagtgagactccgtctcaaaaaaatttaaaaaaaggccaggcacggtggctcacacctgtaatccaagcactttgggaggctgaggcgggcgtatcacaaagtcaagagatcgagaccatcctggctaacatggtgaaaccttgtctctactaaaaatacaaaacattagccaggcatggtggcacgcgccctgtagtcccaagctactagggaggctgaggcaggagaatcgcttgaacctgggaggcagaggttgcagtgagccgagattgcaccactgcactccatgcactccagcctgggcaacagagtgagactccatctcaaaaaaaaaaaaaaaaaaaaaagaaagaaagaaattgctgggtatggtggctcacacctgggtatggtggctcacgcctgtaatcccagcacttcggcagatcacctgaggtcaggagttcgagaccagcctggccaacatggtgaaagcactgctctactaaaaatacaaaaatacctgggcatggcggcaggtgcctgtaatcccagctactcgggaggctgaggtaggagaattgcttgacctcgggaggcagaggttgcagtgagccaacactgtgccattgcactccagctggggcgaccagagcaaaactctgtctcaaaaataaaataggctgtgtgtggtgactcacgcctgtaatcccagcactttgggaggccgaggcgggcggatcacaaggtcaggagagcgagaccatactgcctaacacagtgaaaccccatctctaaaaatacaaaaaattagccaggcgtggtggcgggcgcctatagttccagctacttggggaaggggctgaggcaggagaatggcgtgaacctgggaggcggaggttgcagtgagcagagatcgcgccactgcactccagcctgggagacagagcaagactccatctcaaataaataaaataaaataaaataaaataaaataaaataaaataaaataaaataaaataagggccgggcatggtggctcacgcctggaatcccagcactttggaaggctgaaataggtggatcatttgaggtcaggagtttggaccagcccagccaacatggtgaaaccctgtctctactaaaaatacaaaaatcagtggagcatggtggcagacacctgtaatccaagctacttaggaggctgaggcaggagaatcatttgaacccaggtggcagaggttgcaatgagccaagttcacaccactgcactccagcctgtgtgacagagcaagactcccatctcaataaaaaataaataaaaaataaataaatatagctggggatggtggctcatacctacaatcctagcactttgggaggctgaggtcagaggacagcttgagccaaggagtttgagaccagccttgcaacatagggagaccctgtctcttttttcttcagatggagtcttgctctgtttcccaaggtggagtgcagtggcggggtctcactcactgcaacctccgcctcccaggttcaagtggttctcctacctcagcctcctgagtagccgagattatgggcagacaccaccacacccggctaatttttgtatttttagtagagacggggttttaccatgttggccaggctagtctcgaactcctgacttcaggtgatccacccaccttggcccccaaagtgctgggattataggcatgagccacagcacctggccaagggagaccctgtctctacaaaaagaaaaaagaaaaaaattagctgggcatcatagcctgcgcctatagttccagctactcaggaaggaggctgaggtgggaggatcatttgagcctaggaggtcaaggctgctgtaagccttggtggttccagagcaagttcctctctcattcataaataaatatatagccaggtgtggtggcacacatctctagttctagctgcttaggatgcataggcacaagaatcgcttgaacttagaaggcggagactgcagtgagccgaggtcatgtcactgcactccagcctgggcaacagagcaagaccatgtctcataaaaaaaaattatatattatatatataaaatattttatatatatatatatagcagccgggcgcagtggctcacgcctgtaatcccagcattttgagaggccgagacaggcggatcacctgaggtcaggcacttgagaccagcctgaccaacatggtgaaaccccatctctactaaaaatacaaaattagccaggtgtggtagcgcatgcctataatcccagctactgaggaggctaagtcaggagaattgcttgaacccgggaggcggaggttgcgatgagctgagatcgcgccactgcactccagcctgggcaacaagagcgaaattcagtacccccccgcaaaaaaaaaaaaaaaagaaacacaggggtaaaactccatgaccttggatttcaaaatgaattctttctttattttttttttgagatggagtcttgcttttgtcacccaggctagagtgcaatggcacgatctcggctcactgcaacctccgcctcctgggttcaagcaattctgctgcctcaccctcccaagtagctgggattacaggcgccctcaaccacacccggctaatttttgtattttttagtagagacggggtttcaccatgttggccaggctggtcttgaacttctgacctcagatgaactggtcacctcggcctccaactcccgacctcaggtgatccgcctcccaaagtgctgggattacagctactcagaaggctgaggcaggaaaatcgcttgaacccgggaggcggaggttgtggtgagcagagagcatgccattgcactccagcctgggcaataagagcgaaactccatctcaaaaaaaaaaaaaaaaaaaagtgcaaatgacaaaagaaaaatacatagctttcttttatgaagtgatgaaaatgtcctggaatatgacagtgatgattgttggaaactgtgaatacattaaaagccagtgaattgtataatttcaaaagatgaatgttatggtatgtgaattacatcagaaatttctaagtgcttaaaaaggcaccatgtaaagaactctgaatatcaggcaaaatgaagttataattcatgtcaaaggaaatgggaaatctctcaagatttttgagtaaagtgagaaaaggccaaataagtactttagaaataaagtctgatgaggatgtgcaggacacactggaaggttgttgctaaaggtgtgggcagcaagccacccaggtgccgaggcaagagaccaagggcacgagctgttccagtataataaaatatataaaataagaatagttatactagatatagatcttagatatgattatatatgaatatcattaatcattagtttgtagtgattactctttattctaatattataataatcctcgctctacaatcataacctaggaaaaaccaggccatacagagataggagctgaggggacatagtgagaagtgaccagaagacaagaggcgagccttctgttatgcgtggacagggccaccagagggctccttggtctagcggtaacgccagcatctgggaagacgccctttgccaagcagaccatggtctagcggtagcgtcagtgtcaaggaaaaacacccactacttagcagaccaggaaagggaatccccctttccccgggggagtttagagaagactctactcctccacctcttgtggagggcctgacatcaggcctgcccgcagttatctggaggcctaaccgtctccctgtgatgctgtgcttcagtggtcacactcctagtctgtcttcatgttccatcctgtacacctggctctgccttttcgttagcagtagcaaattagtgaaagtactaaaagtctctgataagcagaaataatggcgtaagctgtctctctctctctcctctctctctctctctctctctctgccttggctgccaggcagggaagggccccctgtccaatggacacgtgacccacgtgaccttacctatcattagagatggctcacactccttaccctgcccctttgtcttgtatccaataaatatcagcgcaggctggcattcggggccactaccagtctccgtgccttggtggtagtggtcccctgggcccagctgtcttttcttttatctctgtcttgtgtctttatttctacgctctctcgtctctgcacatggggagaaaacccaccgaccctgtggggctggaccctacaaaaggactagttcaggcaacagagattaaagtccagaggcagctaagatgcaggatacaatccaaacaaagaaatgagaggaggccgagaaaggtggctcacatctgtaatcccagtgctttgggaggccaaggtaggaggatcacttgagtccaggagttcaccaccagcctggagaatgtactgagatgttgcctctataaaaaatgtttaaaaatttagcaggctggccaggcacagtggctcacgtctataatctcagcactttgggaggccagggtgggcagatcaccataagtaaggagttagagactagcctggccaacatggtgaaaccctgactctactaataatacaaaaaaattagctgggcgtggtggtggcacatgcctgtaatctcggctacttgagaggctgaggcaggagaatcacttgaacccgggaggcagaggttgcaacgagccaagatcgtgccattgcactccagcctgggtgacaagagtgaaactccatctcaagaaaaaaaaaaaatttagccaggccagctgcagtggctcttgcctataatcccagcactttggggggccaagacgggtggatcatttgaggtcaggagtttgagaccagcctggccaagatgataaaaccctttctctactaaaaatacaaaaaaattatctgggtgtggtggtgtatgcctgtagtccttgctgctcggtaggctaaggtgggagaatcgtttgaacccaggaagcagtggtttcagtgagccaagatcgtgccactgcattccagcctgggagacaaggcaatattccatctcaaaaaacaaaacaaaaataaaaatttagccaggtgaggtgagcccaggagtctgaggccgcagtgagctatgagcccagaagtctgaggccacagtgagctatgaccataccactgcactccagcctggacaactcagcaagaccctgtctccaaaaaaagaaagacagagggagagagagagagagggagggaggaaaagagggagggagggaaaagagggagaaaggaaggaagggaggcagggagggaagaagggaaggtgggagtgagggagggaaaagtataattccagagacattataaggaaatggccatagatataaatgttactgattgatgactgaatgtaaataagatgaaaaagagaggaaataatgaatgatgagaacactttggagtttggattgaggggtccatctacaaacagcatgttaggatttgtctaggaatgctgatatccaaaatctggtggataagattcaagaaaatgacactacttctttagcaggatgagaagcatcagtgcagggaaggaggaggccagagctttgccatggtgaatgtgagtccctggcatcctgcacatgtggccagtggctcccatacaaaccagaaaacaccaacaaatgcaagaaacatgtcctccaggccaggtacagtggctcatgcctgtaatcccagcactctgggagtccgagatgggtggatcacctgaggtcaaaaggtcaagaccagcctgaccaacatggtgaaactctgtctctactaaaaatacaaaaattagagccaggcatggcggctcatgcctgtaatcccagcactttgggaggccgaggcaggtggatcacgaggtcaggagttcgagaccagcctggccaatatggtgaaaccccatctctactaaaaatataaaaaattagccaagtgtggccgggcacggtggctcacgcctgtaatcccagcactttgggaggccgaagtgggtggatcacgaggtcaggagatagagaccatcctggctaacatggtgaaaccccgtctctactaaaatacaaaaaaacactagcaaggcgtggtggtgcatgcctgtaatcccagctacttgggaggccgaggcaggggagtcgcttgaacccgggaggcagaggttgcagtgagccaagatcgcgccactgcactccagcctggcaatacagcgagactctgttttaaaaaaaaaaaaaaaaaaaattagccaggtgtggtggcacgtgcctgtagtcccagctactcaggaggctgaggcaggagaatcacttgaacccgggaggtggaggttgcagtggagtgccactgcactcctgcctaggtgacagaatgagactctgcctcaaaaaaaaaaaaaaaaaaaattaactgggcctggtggcatgcgtctgtaatcccagctactcgggagggtgaggcaggagaatcattagaacccaggaggcggaggttgcagtgagccgagatcgcgccactgcattccagcctgagttataagagccaaactctgtctcaaaataaaaaaaagaagtaacaagtcctccagaggttgcagagagctgagatcaagccactgcactctagcctgggcaaaagagtgagactccatctcaaaaaaaagaaaaagaaacaagtcctccagagaaaaggaggacagtacacactcaaggggaacatgatctcgttctctgccaggcttatttctctaaacttcatcctaactgttagatctattccttcaagctccagctagggcccaagagagaaatttacaagctgaagccaggctcctccatttttgctcctcctgccaatagccactcctacctttaggtcaatgatcccactcttctgcactgggaggtaggtgacctgaaagccctcagcttccagtgaacggcaggagtccaagacacatttgtgttctgtctgggtggtgatcaagtgctttttccgtgacctgtagaatcgggccaccccctagaaattggtggtgacagatggaaggagaacatactcagagagacagcaatgacttcaatctcatttgtaaaggaaaagtgggcaagaacagtatgctccaacaccagttctctcataccaactgagtatcctataattcaattctgaggctaactctccagacttagtgaaaaccccatgggttaagggctcaatcgtacaagactgcccctagttcagataccagacataagtcccaggggtctcaagctacccatacttctgcccagtcaaatacaaattcagggcttcccgaagcccggtcaagttcaataattcactagaataaatcacatttgtccaaacccatagaatgtacaacaccagtgaatcctaatataagctatggactttgggtgataatgatgtatcaatatcaggtcatcaattgcaacaaatgtaccacttgatggaggatgctaataatggcagaaggctgtgcatacctgggggcagggcatatataggaaatttctataccttcctttcaattttgctgtgaacctaaaactgctataaaaaataaaatctattaaaataataatagtatacagattaatgtaggtatttaaaaatctggagaaatatacagcaaattagcagtgaaaatgtgtttagagttctactctatattattggaatttatgattcattcatttaaccaatatttagcacctccagtatcccaagtaattttctaggtgccagtgatataacagtaaacaagtcatgagtaggtattactgttaatatcacaagaaacaataaaggtacatttaaaaattcctggaatttcaactattacaagaaactaaaaaaaacatttatctcattgaagaaaaaaaaaaagcggccaggtgcagtgcctcacgactgtaatccgagcactttgggaggccgaggcaggtggatcatctaaggtcaggagtttgagaccagcctggccaacatggggaaaccccatctctactaaaaattaaaaaataagccaggcccggtggcacgcacctgtaatcccaactactcaggaggctgagggaggggaatcacttgaaatcaggaggcagaggttgcagtgagccaagagtgctattgcactccagcctgggcaacagagcgagactgcatctcaaaaaaaaaaaaaaaaaaaaaaaaaaagaacgccaggtgcagtggctcatgcctgtaatccctccactttgggaggctcaggcaggtggatcacgaggtcaggagtttgagaccagcctgacgaacatggtggaaccccatctctactaaaaatacaaaaatggccaggcgcggtggctcacacctgtaattccaacactttgggaggccgagaagggagggtcacctaaggtcgggagttcaagaccagcctgaccaacatggaaaaactccgtctctactaaaaaaaatacaaaaattagccaggcgtggtagtacatgcctgtaatcccagatactctggaggctgaggcaggagaatcgcttgaacccaggagttggaggctgcagtgagccgaggtcacgccattgcacttcagcctgggcaacaagagcaaaactctgtctcaaaaaataaataaataaataaaaataaaaatacaaaaattagcgaggtgtggtggcacgcacctgtaatcccggctactcaggaggatgaggcaggagaatcgcttgaacctgggaggcagaggttgcagtgagccgagatcatgcccctacactctagcctgggcgacagggtgagactccatctcaaaataaataaataaattaattaattaaaaaaaaaaaagggggctggatgtggtggtggctaatgcctataatcccaccactttgggagactaaggcaggaggatcgcttgagctcaggagttcaagaccagcctgagcaacatcatctatactaaaaaaaaaaaaaaaaaaaaaaaaaaaaaaattagcctggcgtggtggtacacatctgtagtcccagctactcaggaggatcacctgagccaaggaggtcaaggctgcagtgagctgagatctggctactgcactccagcctaggtgagatcaagactctgtctcaaaaaacagaaaaaagaaaaaaaaatgggccaggagcagtggttcacacctgtaatcccagcactttgggagactgaggcaggtggatcacctgaggtcagaagtttgagaccagcctagtcaacatggcgaaaccccgtctctactaaaaatacaaaaattagctgggtgtggtagcaggctcctgtaatcccagctactcaggaagatgaggcaggagaatcgcttgaaccctggaggcagaagttgtagtaagccaagattacggcactgcactccagcctgggtgacacagcaagactcccccttgggaaaaaaaaaaagaattaacagtatcaactttgcagaacaggatcagggactggggtccttggggaaggagaggaagatttacacttcattttattttatttttgtttatttattttttgagacggtctcattctgtcacccaggctggagtgcagtggtgtggtctcggcccactgcaacctctgcctcccgagttcaagcaattctcttgtctcagcctcccgagtagctgggactacagccaccacacccagctaattttttgtattttttagtagagatggtgtttcaccattttgcccaggatggtctcgaactcctgagctcagacaacctgcctgcctcggcctcccaatgtgctaagatcacaggcttgacccactgcacccggcctacacttcattttaaatctttccattggttttaaaaaaacacaccatatgtgacagaattatttttcaaaaattaaaaacttggaaagaaaatgtgcatctctccccagagcttataaaagactattacctttaacagcagaataaaaagccaggtgcagtggctcaagccagtaatcccagaactttgggaggcaaaggcaggaggatcacatgagcccaggagttcaagaccagcctgggcaacataatgagagccgcatctctacaaaaattaaaataacaggccgggcgcggtggttcacacctgtaaaaccagcacttcggttggccaaggcaggcggatcacaaggtcaggagatcgagaccatcttggctaacatggtgaaaccccatctctactaaaaatagaaaaattagccaggcgtggtggtgggagcctgtagtcctacctactcaggaggctgaggcaggagaatggcgtgaacccaggaggcagagcttgcagtgagctgagatcacgccactgcactccagcctgggcgacagagccaggctccatctcaaaaaaaaataaataaataaattaaaataacaaaattagacaggcgtgctagtacacgcctgtaagcctagctacttgggaggctaagatgagaggattgcttgagtccaggagttcaaggctccagtgagctgtgattgtgcaactgcaccccagcctaggtgacagaatgagaccatgtcttttttttttttttttttgagacagagtttcgcccttgttgctacagtgcaatggcgcaatctcggcccactgcaactgcaacctctgcctcctgggttcaactgattctcctgcctcagccttccaagtagctaggactacaggggtgtgccaccacacccaggtagtttttgcatttttagtagagacggggttttaccatgttggtcaggctggtctcgaactcctgatctcagatgatctgccggtctcagcctcccaaagtgctgggattacaggtgtaagccactgggcccggctgagaccctgtcttataaaaaataaacacataaataaaataaaagcagaatattaaaccatataggacaaaattataactatgtaaaaatggtctgttcatgaggacaaagaacataaatgagaaacatttataattgatttatactctattttatcctaaaaagtatttacatcagtaagtaaaaatggttgtggggcactttgggaggccgaggagggcggatcacgaggtcaggagatcgagaccattctggctaacacagtgaaaccctgtctctactaaaaatacaaaaaattagccgggtgtggtggagggcgcctgtagtcccagctactcaggaggctgaggcaggagaatggcgtgaacccaggaggcggagcttgcagtgagtcaagatcgtgccactgcactccagcctggatgacagagtgagactcagtctaaaaaaaaaaaaagaaaaaatggttgtgggatggtgatgatagttcaaaatgttacagttgtttataaaaatttcatttaaatgacatttcaccacccacccaccttattttatctcagttacccatgatgtagatttctttaacaatttatagattattttactctaccaatcatggagattaaaagaaacatcatcacaggtactcttagcgatccttgacctgttggtttggaatctgtggagacttccaaagaaaatattttcgaagttttgaaaatgctctccatttcagaaaccatctccacctttggaggaaccttcaccccgactctctggtctctgcagtcccaaggaaggatgccttcctgttaacatgatcaggcagagtgctgatgaccctgaagcccgtcctaggcctcctatattcaggccaaggtcaaagaaaccaacactggcagcacagttcaaagacaaagatgagagcaagtggagccagagttcaaagtacagcaagccacaatttctcagagccttggcatttactcacataatcctggcaaccaggcccagtgaaatctgactatgttctatgaaacaccaacgtgactactaaaagtaccttttccttgcattagcaccaaagatcttctatgtacccaggacaaaatgactgatcccagaatgggtgaccatgtgaatgcctgcagagggcaccacaaagacaagcacttcaaaatggagatatctaaagaaacaggaggaacttgttgcaaatagatctgatcagaaagaaaaaggaaggctgagaggaggacagccctgaaatcacatatataacttgttgttactagataaaaagaatggagaaaggccgggtacggtggctcacacctgtaatcccagcactttgggaggtcgagatgggaggatcatcaggtcaagagattgagatcatcctggccaatatggtgaaaccccatctctactaaaaatataaaaattagttgggcatggtggcgggcacctgtactcccagctactctggaggctgaggcaggagaatcacttgaacctgggaggtggagtttgcagtgagctgagattgcgccactgcactccagcctggcgacagagtgagactatgtatcaaaaaaaaaaagaagaatggagaaaaggttcaatcaccattatccactctctgaagtaactgccagacaaaaaaaaaacaagtggttaatggcctgagggccacctcctttgctatccaactgcctcactcaactcagaccaacagcagcaaagacttaagaaagagtagactgcaaagggttaaaggaagcaacaaatcagaaagactgcaagccttctcttcacaatggggtggggatggatggctgcgaaatacatatacgagtccaaatgatggagggacactatctcctaggtcaggaaagcccacatacaccctctggttcccttctcttaccttaattgctatgttgttggattcagtagcaccactagtaaaaatgatctcacgaggatcagctccaatcagagatgctacttgctgcaagccaagaaacagagatatataacatcagttccccaggcagaaatagagctgcagacacaggtgggacagccctggagcaagaagagctccactgcattccaccaaattgccctggatgaaggtctgcacctacaagaatcagattctagttatatcccagatcccaggctcttttccagcccaatgcaaaataataactttttttttttaatgaactattggccaggtgtggtgggtcactcctgtaaccccagcactttgggaggccgaggtggaaagatcacctgaggtcaggagttcgagaccaacctggccaacatggtgaaactccatttctactaagaatacaaaaatattaggccgggcatggtggctcaagcctgtaatcccagcactttgggaggctgaggcaggtggatcacctgaggtcgggaattcaagaccagcctgaccaacatggagaaaccccgtctctactaaaaatacaaatttacccgggtgtggtggcgcatgcctgtaatcccagctacttgggaggctgaggtaggagaactgcttgaacccgggaggcagaggttgcagtgagccgagatcgtgccactgcactgcagcctgggtaacaagagcaaaactctgtctcaaataatagtaaataaataaataaataaaaatacaaaaatattagctaggcatggtggcgtgtgcctgtaatcccaattacttgggaggctgaggcagcagaatcacttgaacccgggaggcagaggttgcagtgagccaagatcgtgcgccactgcactccagtctgggcaacaaatgtgaaaactccatctcataaaaaaaaaaaaaaagaactattgagctcttactatttatagtacttcttacttacagatgttgtggtaataaacactttatcagcattgtcttatttaatccacccagtaaccctacagagtagaaactaccacaatctctgttttaaatgaggaaaataaggctcaaagaaattagataacttgcccaagtcatttagccaggaaatatgggaaccaatcaaatgcctgcagtcaaactccaaggctgctctttgaatctcttccagaaagaatccaaaaccatttctacctccatgcacacctaccaagaaagaaatgcctcccacaggccactgcccctctttgaccttagaacctcctagactcctgtgtactaacctgacgagcacgttccatggctgcctcactctcccagccataagcatgtgtccgggagtgtgggttcccatagtagttgattaggtaagggagcatggcatcaagcacccgggggtcctgaacacaacagaacagatcattttccttgagcgcatcgtcaattcaggtcccactccacccctcagacctggccaccctgccttaagacactctcaacccctcaggcactgcctagaggaggcctcaaacattcttttgttcccacaaaactacccaccaaatatcaacctaatacactcccactcacaacccatcccaactcggattgttctgcctcccctcaggtagtctacaaacactgccttgttccgacatctgtttctgctggtgtttccattcctgccaggtaatgtgatctataaggggctgggacaggacagggcctaggcaaacacccctggtcacacattggtgaaaacttgcattagtcttttaacccgtttaatacttgtccaagttcacacagttactaagtggccgttctgctcattccagagcccatgcttttaactaatactatagagcctgcgctgaagtgatctgaccaaggtcaattgctagtgagtagtaaagccaatgccagtggcctcgaatttaagcctcccgactcctcgctcagtgctttttccagcacaccttcacggctctcacttctccagggattcagccatttctttgcgtgatcacgcccatcatttacttcctataagcagccttgggaaaagcttcatccttaccagaggagttgtagcttgcacatccatatagagaggtcgcagcactggccccacctccggggcagcggctgtatctgcgggaaccgcagactgaggagcacggtctccaactgataaaaaatggaacggagtagccaagtaagaccgaaggcaactatgaacgcatggcatccaaagggcagaaggaaaaatctggctggaggtgagataagtgtaagggatgctagggtcgaatctcaatggaaagaaaacaacaccagatacctgacacgctgtaaaaggaggtaagggagagggagagagggttcctggagggggtgttgagttgatattcaaatggtatcgtaggaaggaaggctctaaagggcaaagacgtttagaaggaacgtggagccagagtaggtgcagtcccttctgaccgaaggtaacggtctgcacgggagcccggagcagcatctgtaacttggccaggagcggtctgaaggacgcgcctccacggctctgggggcctgtcgcgcagggtgcgaggggtggtgcgccggggtcaaccgttcggggacccgcctaagaaagtttgagggatgtgtcatttgagagaagggtcagagggtctgggcagcagggtggacaggaaggctccggaatattcagttgcgtcgccgcgcggaggggacaggtccgcgcctcccggagagcgggacccgagcgtaccgcgcaggcgcagcccccgagtgggcgccgcgggcttcggccctggagccgctgtcaccgccactgccgcccgcctccaagcggctcggagcagcatggtcccgctggcagagcccaccttccgaagccgctgcagtcctgggccccaggctcccggaagtgctgcccggcgctccggaagcgattcatcgggccgcgagcgccctccccgtcgttttccgtgagagacgtagagctgagcgacccagcccgcgagcgaggtgaggtaggcgccgggcgacgcggggccggaacgcgaagagggtggtggagtcgggctacccactgattttccttcccttacttcccctgagcccttgggcccacttcccagcctaccgcttccgtccccgcccgactcttgggccagcgcctgggcccacactttcctatcccccgcagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggtgaggggcgcgggcggtgatctctgggcaggacaaccagaccttccggccctgccccattcggcctggagcctgaacacagcctccttctttcgacttccctctctgtcccctcgcgagccagactcattccaaaccaccttcaatctgtaaagtcaggttggaagcgtcagtgcttaagaatttgagctttagagtcaaaatgctttctggcccttttcttactggttcggtgactttaggcaagttggagactgggtttccttaagtgtagaatgaagacagtagcatctaacttatagagttgtaaaaattcgatcagcacactttgcacagcatctggcacatattaagtgctcagtaactagttactactgttgcttttatttttttttccaattgcgcataaggaaagaaactcgttcagcggttttactattctggatacaggatacagagataaagcagttaaactttacactctaaaggtcattttcacatttagaggctgttattgccatatccctagattgtaaattatcatttacagagcacttactctatgttaagcactgtgctaaatactgtagttttcaaaatcctgtaaataatgttgagatgcccattttacacttgacactatgtgtaaattgtagagctgactcttgaacccccaccttactccaaaatcattaacaccaagaaactaaaagacagatgtctttattgggtcttaaactgcaggcaacaccagtcaaaaaagctggtttctctatgtattttacactgcatctgctgcctcccacaaactgaaggcagttaatacgacatccaccagaaaaataccctggagacccagatggatctttttccttctcattacccaccccaggtagtaagatataatatccagtaagtggaaaatcagatgtaggggttgctagactagtgttagcaaaaaattggaaaggagcagttaatactctttctgatatttttgttaccaaatagctccatcttggtttcctcctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagtagtcagtgtccctctcttaaaggaatattcttctctcagcctattatccagctttgccaaggatcttctgcactaaagagatggactaacgtaatgactagggttagtatctctttcacaaggcctgcctctcttaatccaaaattggaaaacttgggagtgtctagtattttccatagatactattcaactaattactcagtacaactctgtgcttgttactacggtcaccattttaaaggagaaaaactacttcaaaaaatggatttataagccgaaatttcctcaaggtcacacattgcattatttccaaagcaatgttcatcctgaggttggttgtttccttggtcgcccaggttggagtgcagtggcacgatctcggcttaccgcaacttctgcctcctgtgttcaagcgtttctcctgcctcagcctcccgagtagctgtgataacaggcacgtgccaccatgcctagctaaattttgtattgttaggctgggcgcggtggcttatgcctgtaatcccagcactttgggaggcaaaggctggtggatcacaaggtcaggagatggagaccatcttgggtaacacggtgacaccccgtctctactaaaaatacaaaaacttaagccgggtgtgttgacacgcgcctgtattcccagctactcgggaggctgaggcaggagaatcgcttgaacccagaaggtggaggttgcagtgagctgagatcgagccattgcactccagcctgggcgacagagcgagactctgtctcaaaacaaaaaaaatttgtattcttagtagagacggggtttcactgtgttggccaggctggtctcaaactcttgacctcatgatccacccgcctccgcctcccagtgttcacatatacaggcataaggcaccacgtccagcccgaggttgttatttagatatacctagtggctttatcagaaaaagcaaaacagttcatccactgtaaaaaaaaatagaaacttctgtagcttctcaactggctaaattccagatgattttctaaccactcatcaacaatctatatagcttgccctccacaaaacttactagtttgatgataaaaagcttctgtaatgaggcagttgtccatctcacctgcccaggccacgcagaccctggagttactaacccgcattgcccattaagcatttcttaaacagaactttcaaagatggtagtaattattataaagataaaagaaaactagatgaacactttggaacactgacaggcaggaggaaattaaggacattaccagattagttacagattttcgaaccagtgggatgctgactcaggaactgattggacataaacagtttcactcagaatgagctgttttctatgcacgacactattcaagttactacactccaaccacatttcctctgaacattatttacacaccaaatttcactctggtagcaactaaattttggcacagatgagattaaccactaaaggccacatttgctggtccagttccctagaaagcaatgacacaacaaatttgttaggaagacttggttcaaggggaaaaactgatagcaggagatactttggaaaaagagcacactgacagagtgtctctgccccaaagaactctgcagtctggtattgaaaagtaaattttcaatgaggctgggcgcggtggctcatgcctgtaatcccggcactttgggaggccaaggcggacagatcacttgaggtcagtgtgagaccagccgggctaacaccgtctctgctaaaaatacaaaaattagctgggcacggtggtgcgcacctgtcccagctcttcaggagactgaggtgggagaattgcttgaacctgggagatggagctgagatcacatcactgcactccagcctgggccaaagagcaagactccatctcaaaaagaaaaagaaattgaaccttgggagtttccatacaaattaaatcactagaacaattattgggataaatgtcaaacaaaacgactgatatgaaattctgaataagcctgtaaaacttgtgcttcaatgctaacaaaaaaaaaagttgaacaaatgaggtaaggaactcagtatttgaagataagctaggagcagcatttcctactcaaaagatttaccaagagataaacagttgaagagaattgagtataaatggtgacagcttgcttcccaactagtatgaaagctcaaaaccccttaatacagtaatatatgcaccttatttaatatattaatatataaatcaattttggaaaccagtttgaagttaagccattttgttaagtatgtattgtaaatggtgaaaatttcttcataaatatgcccagacaatgcaggagaccaagaatgcccaggttttaaggccaggctgtttccttttctttttggtaaacccctcagttttgatacattcttctaaaatacacagggctagactctaatagaataaaggaattcatgggggacaacgtgagggcaagtttccgcagactcggaacattttcccaagaggcaagtactgaattgagactaaaagaagctaattctgttctcaaatttctgtaactttaaaacatttgaaaaatgaagatctcctgtggcctttttaagagacttttatttgagtggttcttacaaagattgttgcaatatgaaagtcatttgtttgatagaaatatcaagctgtcttgtcaaacacactgaagtaacccaaaaatatatttcagagctcacagagcttaaaaagagcaaagattatatgcaaccagacaaaacctatttctgcatttcctatttctttctcagactgctttgcctaccagactctcacgtttaaacatcttcaggaaatgcagggatcattttgtttggaattttaagacacaccagaacacatagtatttacaaagaaacttttacagatacattaattgaaaagataccatcaagaaatataattttgaaatctccctttcttgccaattgatcagaatgcaagatgagatgctaaccaaacagccctttagctgtcttgtatttccatacactaaatgtgtatttcagaaactgctcaaccatcagccaaatatcaacattagtgaaatgtgaaatgtaaccactgtgtaaaaagttaggcttctgaaacattaaaaacattacatccctggtctgcctttttacagaaagcacatttgttctcctagagctattcctatagttcattaattttctacatgaacattttaaaaggcagaacaagagaacagttttgtatacagtgggatttactatttagggagaatgagcacactgcattcctgttaacatttttattttttcaaggtaacaggaaattgcatacaaatgacagtagatccttgcctctttatttttatctaaataaaagataactcaagatgaattctcaagaaagaaaaaaagctatatacataagggactatatcttccttcatcgtctacttggaaccagtagctgtgttgctgtcatagaatcaggaaacaggttgtggtaagttggaagaggtacatatgctgctgttatcattttacctattaaaagaaacagacatgttgggtttagcatcttcattatagagccttaataacaatcagtcaaaaaataaattcaaactcaccagcaaaccacctgccatgcaatgcattgacagcagcaatagctgcagcaattgatgggcacttcacatacacattgccctacagaaaaaatgaaaaaaaaggtaaagatgttgctgtatgcaaaatggacccaagttatgtttattcaagttgcctgtagaaacttagtgctctataaccacaaactggtttaccataatggttccactggctaataggtatactagaattttattaaaaaatgacttctactctcaaatttgccgttttatcttttctctacgatttgtatgcagcctaagaatgaatcaagatgccaagatttcatggcaagctttgagcattactagaaatcctctcataccctgatcaaattgttactgattttcttttattttggagggtttatttagccactatattaaagctactttcaggcacacacacacaaaaactataatggaagacggttaaccataacatgcaccacataatgtgcgaagattaaggtagagacgaacaacctaacatcatttataaaaaaagatgaaaatacctgagctgaatttttgtcaacataaatatgaataactcctccatgtttattacattcttcaatcacatcatccttaatctcggtatcccatccaacttcttcttctctgtaagaaagtattaaggactcttaaatactattgaaactaacaaactatatatttacaaatgtatcaaaaaatttaaatattctatgaattaaaaaaaatactttggaaaaaaagcacattgacagaacgtctctgccccaaagaacactgcagtctggtattgaaaaataaattttcaatgaggccgggcgcggtgactcatgcctgtaatcccagcactttgggaggccgaagtgggcagatcaccagagatcaggagtttgagaccagcctggccatgatggagaaatccggtctctactgaaaatccaaaatttagccacgagtggtggcagatgcctgaaatcccagctattcaagaggctgaagcaggagaatcgcttgagcctaggaggctgaggttgcagtgagccagtatcaaatccctgcatgccagcctaggtaactccgtctcaaaaaaaaaaaaaagttaaaagatacagatagggctctggggaaaatcaaagcaaaataagatagaaaatattgatcccatcctactttatgactctgcataacttgaaagtgacttttaaatagttaaatgggccaggcgcagcagctcatgcctgtaatttcagcactttgggaagctgaggcgggcacatcacttgaggtcaggagttcaagaccagcctggccaacatggcgaaaccccagctctactataaaaatacaaaaatcagccaggcatcatggcacacgcctgtaatcccagcactttcggatgctgaagcgagcagatcacttaaggtcaggagttcgagaccagcctggccaacacggcaaaaccctgtctctactaaaaacacaaaagtagttgggcgtggtggtgtgcacttgtaatcccagctactcgaaaggcatgagaactgcttgaacctgggagatggaggttgcagtgagctaagatagagccggtggcgccactatactccaacctagactgagactctggctccaacaaaaaaagttaaatacttcaatgctatcaaatgatacttacaacgaaagtttatcaccatttcatagataaaactaaagtaaatttggtactgggaaaacaaaagaattcaagactctttggatgaaacagtcatacaattgtcattatatgaaatgtaacttattgaaatcgaaacaaaaatctacattttgattggatgtactatattataaatatgatttataaaaccaatgagaagagttaaaaaatagcattctaatcactagctaggcatagttactagcattctaatgctaatagttattagcatcctaatcactagctaggcatagtttccgcacctggccgaaaaattattttaaaaggatcaaaactatgcagtttcaaatgaaatacggaaataccaggccgggcccggtggctcatgcctgtaatcccagcactttggtaggctaaggtgggcggatcacctcaggtcgggagtttgagaccagcctgaccaacatggtgaaaccccatctctactaaaactacaaaattagccaggtgtggtggcgcatgcctgtaatcccagccactcggaaggctgaggcaggagaatcgcttgaacccaggaggcggaggttgcagtaagccaagatcgcgccattgcactccagcctagacaacaagagcgaaactccatcttaaaaaaaaaaaaaaaaaaaaaaaagagaaatatataaaacaactctattgacgccttgataggaaatatcaagaataaagtccattacttacgtttgagggttaaacatgttagagagttggaaacattgtgttgcaagtggctgaacagaggcagctgcagctaaagctgaagctaaaaaaagaaagagaaaaattagtttcatggaaaatgcatgaaagtatccctcataaatactttaaaacgaaaccaaaaacccaccccaagcatgtaactaggatgtcactggagttattttaccttatttaatattgctactaatgtatgttatcagtagcttttaggtgccagaaaactgaggtaacctaatacttgaaacagacattcagaaatttgggagtcctattttaacagggaaattaaactttatgtgttatcaaaatcagttcaattagacaaaatctcaatacacatcaatccaaacagatgaaggataaaatagatttgagtttatacccaaataagaggggataataaaacaaaatcctttgaaatgccaaataaatctatatcctttcctatttcttcgctttctgcccacgaagttttttaaatctacaaattattaaagaattaagacatataaaatcatccaagtgtttaaagacaatgtcctagaaaaataaatcctattaacaatcctattaaaaataaatcctattaataaatcaaatgttttaaaaatgttttcgcacaataaaagaacactgaaaagagcagcatatatgtgtaatatccactactaccaaaacatactggggtttgaagtttaaagagcattttccaagacagttgctccaatgctttcacgtgatttacaaaaatattaccagtagctgttacagaactcaccgtaatcatattatctgaccaaatttcattccaaaacataataacaaacaaagctaaggataaaacagtgcattagaaattatggtaattaaaataaacgatcacttaaagtatcagaaatattacaccgagaaattagggctgtgcatgaaatatatcataaatgataactttctggtagcattacaggtgctttagcttctctgtaacatataagttttttctttcataaagttttattttaaataaaacaaaattttaatataacatgtcaaattctgctggaaaaaagttaaagattcgagagtgtattataactgtgcaaaaatgaagctcactgtgtagcttacagaagatatggaagtatccttaaaaaaaactagaaagtctaaacagaactgaggaagacttgattcttccagtttctcaagtttagtatgattatatactatgaatactaaaaaatattaagaaaacgtactatacaaacattcacgttcaagctagatcaatgcagaacacagtaaatctaggaaaatcttttaaaaatctcttaacaaaacagcactgattagaagcatcttgtttgtgaaaaaatttaattcttgactgtgatggaacatgacatatctttctcataatcatttccctaaacattaagcatactcctacaaaagatatagaacttacattaacagcaaaatgctcatgtcaagcaacagagatttagtgataactaaaaacaagaaatcatagcctacttaatgaatggtttctctgaaatgtgcatgtaatttaagtatgtataaacctcttattgcttggtactggcttaaataaatcactgagtactatgtcttaagcaaaaaaaggtgagttttatagcatgattcacaactttatactaagacaacttccagattccaggttctaaaatacttgcctactcgttaataagagaatacttcatttcctgacttctatatgcaacttatcaacacttagaacacacaggtaggcataaaacaaaaacaaggttgaaaattttaagcaaactaaagcaaaaaaaaaaattgttattttgattttttttaagtccattaatttgggttaggtcttctgaaatacagacagattactatgaatataccactatgtgtcactgtgtcaaaatttggtccaaattactggtataaaaatatgacaataaatatagaaaactgtcttactacatttaattctatttcaaagacaaaaataaaaaatatgaacacttcaactcaccttcagtctgctgggaaagtcttgtttgcaaatctataacaaaagagaattctacagctcagtgcaggaacaatgaagagcctcaactaacagggtaaatgtcaggaaagcattaataaaagaggactacaatagcagggttcattcaaatgcacttagtaaaacctggcagcaaaacctccttccccattcctcattgagaaggctttggggccttttttccccctcttatcctgggaaacttacttttccctctctcttcctagactagactactcttccacatctcaagtgattttcactacactactatacagctgggaataatgggaaatggggaaagggaagcacaccggtcagaaaatgagtgaaaaaccctgatcttgagaattcaattccaagtacttgggaaatgcaagtatttatatttttagtggccatagtacttaacactttaaaaggatattataaaattgtaaatactgcacatcaaaaagctgtaacagtttccatgatttcccaatttaggaagaacatcaccattgggaaatacaccattccaacagtatgcatatattatttttttaaggacttttcaaagatttaacttgtcaaatctagcccataatggggcaacttgattattgatttcctggcctagtgtaaaaatttagcaaggcagaaataaaaatctctggagttttcttaaaagctatgaagtttaggaaaatgaaaacatctaatcagtattaaaaataagagggatgtgaccaatatattttctcatataatcgttagatttctacagtggacgccatctgaaagctgctacagagtgaaacagtagcaagtctgaacagtaagtctgccacagtgctataatgctctcttgaagttctttttatagaaatatatgacatcaaaattttgattcagtaacctgattttcattaaaatttgattcaactgcaacactttattaccacatatatgggtttcttgcaacatgggcaaaaatgtacagggatctgcagcccaagttatattgggataaaatacctgggtcctaggtgctcaaaattggcatctcagggagctgaagaaatgtaactggtgtatactgaaggaacttgaagataggaccatgtgaacagtgtcaataaactttaaataataacagaatttgtcttttttttcctaaaatgggaaaaaatgtatagatatcagaaatccatgctattttgtctaccaacccaatcataatttcaaaaatgatttgtcatatcatttgtgacaaagtgaaaaataaagcatggttttcataaagataaggactctaacctattttagaaagggcctatcaaactggcagaataaaataatgtggatatagtgatgacccatccctagtttcacccaatagctttaaaagacttaggggacaagcacctcaaacacagtaaacactcaacaattttatttcagcaagttatatgtaatattttaatgaccaccatctggagaaaaatatccagttacacagatattcacctaaaacatgagtgttattaatgcagaagaaatttatagcaaggctaataaaacagaatgatctttaaaatcatctctaccaccaccagcactaaaaaagggaatgtaactagatacatagataaagggtagggacactattgtcaggaatccatatggagctttaggattttagctggctacattcaaacaatcttaatatatactacacgatgagaaagaacccaagaggtacattcatccataataaaagaaataaaggctaacggtagaactgatatttaacagtggataatcttcagttaactgaagacattaagagcaaatcaacgtatctgatacagcatccagggtgtaagaaaattgtctataaatgacccctttgtcactgtatcaattccctgaaggcaggaagaaatctttcaccaccctttagtggaatacctagaacatgaactaaaaattttcttagttgtcaaagaacattatgaacaatgagaagcaatacaggtaaacagttttctggttaaaaaaaaacctttcaaactgtaataataaactctaggtaatgagtttactatcaattagagcaagtagcaatcgacaattactcactgtaaaggatcgaatagctaacactataagctcaaaataaattatgtgttaatccaatggaataaagataacttgaggagggatcaaatgactgttaaatacacaaatgccttactggttctgattcttgtaagtataaactggcttcgctgtcagaaattctagggagtaactgcttgtcaaatttcaaaataagtcatacaatttatagaaaggaaatgaaaccaaatgcaggttttctaaaggtactcacacacttaagaacaaccactaagaaggcaaaacagtgaaaaaataaatgtaaaaacaaaagtcgtcttctactttaattgaatattgagctttcaatttagaagaaaatcatgaagcaaccacaggacctcttcgtactttcagatgtggtactaccagggtctaaaatctatcttctcagttacagtctcacttcgtatatatatataaggtcaaaggaccagccaggtgagggggctcatgcctgtaacccaggattttgggaggtcaaggcaggcaggtctctactaaaaatacaaaaattagctgggtgtggtgggaaatgtctgtgatcccagctatgtgggaggctgaggcaccagaattccttgaacccaggaggaagaggttgagccacagagtgagactccatcccccaccaacaaaataacaaaaggttcttcttatgatgttctaaaagcacgtctttgacatttcaaaattagatcctatcctatctcccagatttgggtcaatgtaaaagttacaggtaattaagaaatgagggccgaacgcagtggctcacatctgtaagcccagcactttgagaggccaaggtgggcagatcacttgaggtaaggtgtttaagactagcctggccaacatggtgaaaccccatctctactaaaaatatccctgctacttgggaggctgaggcacgagaactgcttgaacccaggaggcacaggttgcagtgagccgagactgcaccactgcactccagcctgggcaacagagcaagtctactgttatccaaaaaaaaaaaaaaaaaaaaaaaagggggcggggggttggggggcacaggggaatgagtgttttatgaactaaatccctttatacataattgtaaaaacgtcaattcacccttcttttcctgttgcctccaaaagctccacctcccaattcatgatcttaaatttttatgtactataaagaaaaataactgtctcaacactcttactactacaatagttttaagtaaagcttttttaagtgcctctgatattttctaaattctaatattataaatattttttcgatcaaacaatatacaccttgtagtattcaataaaactgatatatttgaaaataaacttatgtcaatgaatttcgactaaaaactggggtgcagggtttaaaactgtcctgacaactcattttgatgcatggttaattctaccctatgtctccacttccttaaatagaagactacaaactaacaggctataagtacttgatgaattgaattctcagtaagtccttttaaatgtaaaaatttggaaaattttcgaattagatgaaaaaacgatttaaaattagaaaagattcaattcctacctgccacagcaccaaatgccaaagagccactcatctgtagagcttgctgtgctgctggcggaatctgcaaacctgtacctgtaaaagaatagtcttaaagttcctactatgttgagagcagagaaacgaagtttcctgggtcattaatatcatgatcacttcactaaaataaattgcaaggagggccgagtgtggtggttgacgcctgtaacttagctagcactctgggaggccaagggaggtggttcacttaaatcccagagatcgagaccaacctgggcaacaattgtgaaactctcttttttttttgagatggagtatcgctcttgttgcacaggctcttgttgcacaggctggagtgcaatggcgcaatctcggctcactgcaacctccccctcccaagttcaagtgattctcctgcctcagcctcctgagtagctgggattacaggtatgcgccaccatgaccggctaattttttatttttagcagagatagggtttctccgtgctggtcaggctggtctcgaactcctgaacttaggtgatccacccgccacagcctcccaaactgctgggattacagttgtaagctaccgcacccggcagaaaccccatctcttaaaaacaaccaaccaaccaaccaacacaaaaaaaaaaaaaaaaaaaaaaaaaaaaaaaccaccacagaaattagccaggcgtggtggtggttgtttgcaactgttagtcccagctatttagagattagggtgggaggatggcttcagccaaagaggcagaggttgcggtgagccaggatcgcacaactgcactccaaattgggcaacagagccagaccctgcatcaaaaaataagaaattacaaaaagaaaaacttgtaacattataatagctgcaactaaatttattcctaagtatgacatataaacactacataaaggaaaagaaatcttgcaacttatactgtggcattcaaaacacataatatagatttccatacattaatacaaggcacatcatctataaaataatatgcagtgtgaccaaggataacgccaactacaaaataagataaaatctttttccctttcttagtttacatggctacctttcttttccactacaatacccacagtaaatcattcgtaatagcaagaaacacttaccctctgcaagtcttgccattaactgaagacgaccagttgttcccaaatcaattccagtcctttccagttcatcactgtccaaaaatgaactagcactcgaagcatcagtacgttcagtaacatgaccaactttcattggtcttcctgctagttcaaatccattaagttgttccaaagcctttttggcacattctgagtcagaaaactacatgataggggaggcaaggacaggagacagtgctttaatttttaaaatacaaactatacttaaaaatatatttatatttttagcatattcaataattacttctgaatactaaggtagaaactgcaagctgtaagtagcaaacacaacatacatgatgacgacgctagctaacgcaaattaggcttgttgatgtggtagtttaaataaaagatattacaagtaatgacagctttatatttgagaacatggggattgtggttagaaaatgtgaaaactggctgggtgcagtggctcacacctgtaatctcaacacttggagaggccgaggcaggcagaccacctgaggtagaatttagtacttttctaacaaaaatgtgcccagggacaaaatagtcaatataatcctcatatataaaacataaatacttcatacacaagcaaataaatacataacttgatataaattacatatatataaaattttggtttacacatatacccacaatggcttatctggagaaaaagaaaaggtggaaaatatccacactaaagttactagaataaaaaaataaaattggtgagctatgtttcataaattttctcctttcaccagttcattgacgtacgtaacagcctaatgaccagtaagttaaacagatttgctatcaacatagcaacaggcttacattttattgaaatgtagatataagctaacaattttaatttcctgatagagatatacagtgtacttttaaaaatactatgtttccaggaccttaaaaggttacagagctcacacatctgaaaaaagttccaccatggatgagtttcatatacatgagtggcaccatctcggctcattgcaacctctgcctcctaggtttaggcaattcttcctcatcctccctagatgctaggattataggcgcccgccaccacgcccggttaattttttatatttttagtagagacaaggttgcaccatgttggccaggatggtcttgatctcctgacctcaggtgatctaccgctctcagcctcccaaagtgctggcatcacaggcgtgagccaccacacacagcccaaaaacacttttgacaagacaattctggtcttggttgtgaggtatgtacattaaaaaaaggatctttagtaaaaaagaatcgttaacagaccttcatttatttaactgttaagaatgtgtcaaaaggttatcagagatgaacgtataaaacattcaattatatgaatagctggctgacccctatatgtatatatagcacatagtaaaggaaaataggaacacagtaatataatttggatccttgtcccctctaaacctcaggttgaaatgtgatccccactgtggaaagtgtgacttggcaagaggtatgacaaggcagatccctcatgaatggcttggtgcactccccctgctaataggcgagggtccttgctctgttacttcacaggatgtcttcctctctcttcctctccctctctccaagtgacacacctgctcctccaagcaataacaagtaaaggctttgcgaagcacaagtaacagcttcctgaggccaccacagactctgagcagctgttagtgtcatgtttgcatggcctgcagaacctaataaacctattttcttaaattattttatatttatttatttatagttttattttttttcaaggcagagtcttactctgttgcccaggctggagcactgcagcgcaatagcacaatcttggctcactgcaatctccatatcctgggttcaagcaattctcctgcctcagcctcacaagtaggtgggattacagttgagcaccaccatgcttggctaatttttgtatttttactagagacggggtttcgccatgttggccaggctggtctcaaactcctaatctcaggtgatccacccgcctcggcctcccaaagtgctgggattacaggcataagccaccgcgcccggccacaaaaactaatttaaagcacttgaaaatattaaacatgccaccttccccaccattattaactattattgtacttctactatgcaacttggatcaaaaaattttaggagtacctaagtgtgatgatttggttttcacattcatgtgtgagctgtgcctgccttttgttacaagggcatattaccctttgttgtgaaaaaaacttttttgatcggacacagaggctcagtcctgtaatcccagcagtttggaaggctaaggtgggacatcatttaaggccaggagctagagactaatctgagcaacacagcaaatgtagtttaaaaaaaaaaaaaccctaagtaatataattatggtaattacttactgtaataaatccatatcccttggatcgaccagtttcactgtccatcatcagctggatactttcaatctataattgaaaagcataattactataacttaaaagcagagtacaaaactactttcttccctgagacatggttttaaaaatctaccagtctcctcatcctccaaaatagaagacttatcacaaaacctcatcaccaagaagtcttttttaagtctagaaactataattttatatgtaaaatgaaaaaaattaggctgggcgtggtggtcggcgcctgtaatcccagcattttgggaggttgagggaggcggatcacctgaggtcaggagtttgggaccagcctggccaacatgacgaaatcaggtctccaccaaaaatacaaaaattgtctgggcttggtggcgcatgcctgtacgcccagctacttggaatgctgaagcagaagaattgcttgaacccgggaggcagaggttgcaatgaccccagagcacgccactgtactccagcctggacaacagagcgagacttggtctcaaaaaacaaaacaaaaacaaaaaaaaaaaacaaactctagaaacttcccaagcgagaaattatgcactggggagcagaggggagaaaaaaaaactatgattgtaacctaagattaatttttatatcaatactaaaccactgaaaaccagaaatccttcgtaaattaccaatagaaggtagaaacaaaatcaacgtttccttcccattgtgctaaaaacaccaagcagtaatttccaattataccagacagaatcgtaaaaatggaatgaatttggcaatatacaatgaatttggcaataactgcacaattctgtgaattgtactaactaaaaaccattgagtttacgttcaatcagtgaactgtaacacaatctcctgatttagctgtccatttaaaaaaaggtatgaaaaattaaaacagagcatccagccaggtgggttggctcaggtctgtaatccgagcactttgggaggcaggaggatcgcatgttaaggaggtggacgctacacagtgagcttgcatcatgctgttgcactccagcctcagtcacagagggagactctgtctcaaacaagaaaggaactttttttttttttgagacggagtctcgctctgtggcgcaggctggagtgcagtggtgtgatcttggctcactgcgagctctgcctcccgggttcacaccattctcctgcctcagcctcccaagtagctgggactacaggcacccaccaccacgcccagctaaattttttgtatttttagtatagacggggtttcaccgagtttgccaggatggtcttgatctcctgacctcgtgatccacccgcctcggcctcccaaagtgctgggattacaggcatgagccactgcgcccagcccaaggaacgaacttttaatgttaagtatattttaccaaaattttaaaaaagaaacaaagtttatttgctagtatttgctaagccacagaaagtctatggaaggatataaaaaacaaaacaaaacaaaaaaaaaacgggtaagggctgcctctagaaaaggagtagtcgtggatgaagtgggactatgatagggataagatattctaggagcattagctagcaaaaagtaaacaatataaacatttaggctgggctcggtggctcccacctgtaggtgtgagctgacatgggcagactatctgagctcaggagttcgagaccagcctgggcaccacggtgaaaccctgtctctactaaaacacaaaaaagtaggttgggctccgtgactcatgcctgtaatcccaccactttgggaggccgaggagggcgaatcaccagaggtcaggagtttgagaccagcctgaccaacatggagaaaaaccctgtctctactaaaaatacaaaattagcagggtgtggtgccgcatgcctgtaatcccagctacttgggaggctgaggcaggagaatcgcttgaacctgggagatgggggttatggtgagctgagatcatgccattgcactccagcctgggcaacaagagcaatactccatctcaaaaaaaaaaaaaaaaaaaaaaagccaggcatggcggcatgcacctataatcccagctgctagggaagctgtagaagaattgcttgaacctgggaggcagaggttgcagtgagctatcgcactccagcctgggtgacagcgcaggactcagactccaaaaaaaataataaaataaacctttaaaaagggcttcttattaaagctgctacattatgtttactggagttgggcacttaatgcatactaattgttctggggcaaaggtaagcaaactacatataccccatgaaccaactccagcttgacttgttttataaatctttctcctgtctgagcctccagagtaagctggaactacaggcatatgccacccaagaccggctaatttttatatttttagtagagaagaggtttcaccatgctggccagactggtctcgaactcctcacctcaagtgatccacccgactcggcccccaaaagtgcagggatcacaggcatgagccactgtgcctggcccatactcaatttcttaatagcttacagctgtttggaagagagttgagtacttgcaacaagaccatatggcactgaaaacctaaaatgggtctgggcgcagtggctcacgcctgtaatgacaacactttgggacaccgaggcgggtagatcacctgaggtcaagagttcgagaccaacctgaccaacacaccaaaaattagctgggcgttgtggtcagagcctgtaatcccagctactcaggaggctgaggcaggagaatcaattgaacctgggaggcggaggttgcagtgagccgagactgcaccactgcactccagcctaggcgcaaggagtgaaactcccatctcaaaatttaagaaatagtttgacaaatcagactctagagtaataaaaataatttaaatatcaactgtttcctgatgttaatttttatatggtacacagatttctcaaatatccatgattattctttttcttttctttcggagacactctggctctgttatccaggcgtgatctcggctcactgcaatctctgccacccgggttcaagtgactctcctgcctcagcctcttaagtagctgggattagagggatgcgccaccacacccacctaatttttctatttttagtagagacaaggttttaccacgttggccaagctggtctcaaactcctgacctcaagcgatccacttgcctcggcctcccaaacaaagagatgggattacaggtgtgagccactgcacctggccagtgaatatatttttaaaagttaaattttatttgttctatctagctccttttaaatttatgccttttgctaaaattattgagtggaaaaggttcattcctcacagtgacaggacagtcttggcaactttctctcctcaacacagaactagttggacactcttggtttaggtagatagcacaaagtcctctagaacaaaagccaagctgctctgaattgagctcaagaccacaatgccagacacaaggcctcgtggcgcctgtgaagcagatcaagttggttcctcactttgccatgtaacagctcatgtggccccaactgctctgaacttcatttctccatatagcacataatggcatgtcaacctccacctaagatccatgttactgatagaaaagtcaatggaggccaggtccagtggctcacacctgtaatcccagcactttaggaggccgaagcagatcacctgaggtcaggagtatgagaccaacttggccaacatggtaaagccctgtctctaaaaaaaaaaaaaaaaattagtcgagcatgatggcaggcacctgtaaacccaactactcggaaggctaaagcaagagaatcgcttgaacacagagaggaggagtttgcagcgaggcgagattgtgccactgcactccagcctgggcagcagaataagactctgtctcaaaaagtcaatggagaaagtaccagagtggatcagaagtgggtcacatactgttaggcagaacagccttgccagaggggcattcacccactgaagatttcaacagacagaaaaagggcaaatctaatcaggctaccaaggcctggaactgagcacataaccagggagacagagtaatgtctttttaaaggtaagggtctcgccaggccaggctggagtgcagtggtgccatcccagctcactgcaacctctgcctcctatattcaagggagaaattctgctgcctcggcctcccgagtagctgggaacacagagacgcaccaacacgcccagctaatttttgtatttttaacagagacgtggttttaccatgttggccaggatggtcttgatctcataatctgcccacctcggcctccctcccaaaatgctggggttacaggtgtgagccaccgcacccggccaacagaaaagaatcttaagatattcaactttcttttaaaaacaatcttttaaaaaaaatcctactaaaaaataatagtcttcgtatgatttaacaattttccttcttttgacacaggatcacactgttacccaaggtggagtgaagtggcataatcatggctcactgcaaccttgaaatcctgggctaatgtcatcctcctgcctcagcaccccaagtagctgggattacaggcatgagccaccatgcccagccaatgtggactttttattaactctaatacccattatgcatttcacatggcattatgaataacagtaacattcttttaagaatctatcaagtgacctattttaatctatgttgtcacagaaatttttataaaaccagcccttatcctcttaatattaactcacagaaagataacaaagcaagacatacagaaattatgtagttatactcagatcaacaacctactgaagattcattgaagaacctggacttactcttccaaaaggctcaaagatcccacgaagcatatcttcagttatgttgaagtgtaatgagcccacataaagcctcataggtccagcacttcccttttgtaaattgtttgccattgctgcagctctgtttttttctgcctagaagacaaaatacacgtcacacagagataacacacagcagtttaaagacatacaccttccatttgcataacaactaatgttaaagtttagagtgataaaaatactaccctacgtaagtcagatactacatatcaacttaataggaggcatctagaatatgcaaaattcagaaagaggaggtagataacattttaccaagggcctgcaggaaattagggagttacagcttcaagagtacagtttttggctgggcacgatggctcacacctgtaatcccagcactttagtaggctaaagcagccagatcacgacatcaagagatcaagaccatactggctaacacagtgaaacaccatctctaccaaatatagaaaaaattagccgggtgcggtggtgggcacctgtagtcccagctactcaggaggctgaggcaggagaatggcatgaacccaggaggcagagcttgcagtgagacgagatcacaccactgcactccagcctgggtgacagagtgagactcagtctcaaaaaaaataaaaataaaaaaaaaaataaaaataaaaagtttatttagaggcttttttttttttttttttgagacagtctcacactatgttgcccaagctggtcttgaactcctaaacttaagtgatcatccttccttctcatccactagagactgccagggactacagcacaccccacatcataccctgcttattttagaatgttttcagagcacatgccagtcacatataaagtaagcaggctggccgggtgcagtgtctcacgcctgtaatcctagcactttgggaggccgaggcggacggatcacgaggtcaggagatcaagaccatcctggttaacacagtgaaaccccgtctctactaaaaatacaaaaaaattagccgggcgtggtggcaggcacctgtagtctcagctacttgagagactcaggcaggagaatggcgtgaacccaggagacggagcttgcagtgagccaagatcgccccactgcactacagcctgggcgacagagcgagactccgtctcaagagaaaaaaaaaaaaaaaagtaagcaggctacatttcacacctaaaatgaatcatgaacctacattcttgacaacaatcttaagatgcattctgataccacaaatactaaatacagagaaaaatgcttcctggaattgttagacacaaccaacattcactaaaatactcttgagattggtataaccgaacgtagttgtttgtgataaaataaggtgtatatgccataacataaaactgtatcaccaagcaaacattttgagtcagctgtcatccctccataaccaagatcgcctcaaaaaaaaaaaaaaagaaaagttgtccatttgcattctaacacaggcttctcttgtaacaaactagagtacattggatagtactgctctacaacaggttgctgcatgaatttaaaacctcacttaatatgctacttctcagccctgggtcccgccaatgcacacccagccactaagtttgtcttccaacataggaaataatttgagtaactcttttttctttttgagacacagtcttggttcttgtcgcccaggctgcagtgcaatggcgtgatcttgcctcactgcaacctctgcctcctgggtttaagcaattctcctgcctcggcctcctgagtagctgggattacaagtgcctgacaccatgcccagctaatttttgcattttagtagagacaaggtttcaccatgttggccaggctggtctcgaactcctgacctcaggtgatccgcccgcctcaacctcccaaagtgctgggattacaggcatgagccatcgcgcccagccaaaatactaaaatattaaatgctgtcaaagcgctgtgcggctcaagtgatcctaacacttcaggaggcccaggccagaggatcacttgagcatgacagtttgaaaccagcctgagcaacatggcaagaccctgtttcttaaaaaaatttaaaaattagctgggagtggtggcacgcacctgtagacctagctactcaggagactggggagaaaagactgcttgagcccagcaggtcaaggctacagtgagctgtgattatctcactgcactccagccctggcaacagaagtgagaccctatctcaaaaacaaggccaggtgtggtggctcacaactgtaatctcagcactttggaaggctggggcaggtggatcacctgaggtcaggagttcaatactagcctggccaacatgatgaaaccccatctctactaaaaacacaaaaagtagccgaacgtggtggcaggctcctgtaatcccagctactcaggaggctgaggcaggagaatcgcttgaacccaggaggtggaggttgcagtgagcagcgatcatgccattgcactccagcctggtgagagagactccatctcaaaaacaaaacaaaaaaaaggcaaaatcattacatttcaaacacaaggagaaacgacaggacgacagtcttgagaaaactgtatcaatgttaataaacgcaaagttaaaaaaaaaaaaaaagtcctgaaaacatccgactcaacgtaatgagcagcagtcacagaacacaacagcactataccatgcaacaggaggctttcaacaccaccaataatcaaactcttaaccaacaaaaaaattacctgtgatgcctgtactatgattggcacgcctaaaactcgttggccagttaatcctattgctagaggcactgagctaacatcgacgaactccacataagcaattcctttggaacgtcttgaatttctgtcagaaatcatcctcacatctcgaacctagaaagaaaacacagttgtttgtgcaaacatccattgtaacacatgtagaattatttcaagagacactgttgaaggatgaaggtatttttaaaaatttaattaaaaaagtaaatctgtaggacaattcctatatcctatctttatctttgaacaaatttgtagtaacatttatcaactccaatactacaagaggcaaaatggaaacattaccacaaacaaatactgctactaaatcaaatgaagtatttgatgtttacatgttttctcttgcaatttctacctacttgacctccctaaacaggttaagattacctttcctactgtagagaaaaactcttccaaatcccttggtcgaattcttgccgccagctgcatacagaagactgtccttgcatctctttcctcaggagttaaattatcaataggttctctaataggagtaaaacatataaaattaatttcataacagattttaaaataatttttatcttttttatttcttcatatagttcaacaggttttcaggtacaggtgggttttggttacatagatgagttctttaatggtgaattctgagattttagtgtacctgtcacctgagcagtatatactgtaccctcactcctttcccaactccacaacaatatttccatctttagaaaccaggtcttgctatgctgcacaagttggtcttgaactactgatctcaagcaatccttttgccctaaactcccccatagctacggcatttcaccatgttaactaggctggtctcgaactcctgacctcagatgatccgcctgccttggcctcccaaagtggtgggataacaggtgtgagccactacgcctggcctaaaataattctcaaacatgttcagtaaacagagtaagctgtgaaactggtttgtcataattcccaaacccattttcttttttttttttttttttttccagaggaagtcttgttcttgtcccccaggcttggagtgcaacggcgccatcttggctcaccacaacctccgcctccctgagttcaagcaattctgctgcctcagcctcctgagtagctgggactacaggcgcctgccaccacacccagctaatttttgtattttaagtagagatgtggtttcaccatgttggccaggctggtctccaacttttgatctcaggtgatgtgcccgcctcggcctcccaaagtgctgggattacaggcatgaggcaccgcacccggccaacccaagcccattttcagtaagatctattgacaaaaaatgcgcataaaactattcaatgtaactcaattccttctaaaaactaaggtttactgtttcttgtaatcacatcttacatggcattagcacagaagtctactggccttaccatctcaaaaaaagtaatttttcttttctttttttgtttttgagatggagtctcactgtcactcaggctggagtgcagtggcgcaatctcggctcactgcaacctccgcctccagggttcaagcaattcttctgcctcagcctcccgagtagctgggactacaggtgtgtgccaccatgcctggctaattttctgtatttttagtagacatgggattccactgtgttagccaggatggtcttgatctcctgatctcgtgatccacccgcctcggcctccaaaagtactcggattgtaggcgtcagccaccacgcctggcccaaaaagggtaatttttctaaaacaagggtcaaccagaagcctgacagtttaatcatagtcataaaacatatcaccagaccaatcacaaatgccagactgatccaaaatcagtgtaatggatgattctttacaacaaaaccatgtaattgtaaagtcaaattaagtttgacaatcacaaatggcaaacttgaagtgaaaccccaaatgattctacaaattctactttacaaatttagatacagtgtctattaacatcatctctgttacaaaatatcaattaaggttgtaagtcatcctttaagatgtaagcctaaacacgatcttttccattttttggacactctcaggatgtacgggggttggggtggtcgctccacctgtaagatttgtcacaaaagcttttttttctttttggaaacgcagtctagctgtcacccaggctggagtgcagtggtgtgatcttggctcatcacaacctccatctcacgggttcaagcaattctcctgcctctcttcccgagtaactgggattacacgcacgcgccactacatccggctaatttttgtactttattagtagagatggggtttcaccatgttggtcaggctggtctcgatatcctgaccttattgttacaggcatgagccaccacgccaggcacaaaagcttttaaggccgggagtagcgtgcagattgcttggccctggattttcagaccaactgagcaacatggcaaaaccttgtctctacaaaaaaaaaatagaaaaattagcagggcatggtggctgcacctatagtcccagctactcgggaggctaacctgggtgggattgcttatgaccggccattagaaactgcagtgagacatgattgcgtcactgcactatagcctgggtgacaaagagaaaccctacctcaaaaaataaaaaataaaaataaaaaagcaaatgctttctagccgggggtctcaaaaaaaaaaaaaaacacccacaatgctaccacctgacaaaatattccttgaaccgaaatcgtagactgaacaaatacagttccctttttttttgtagacagtcttgctctgtcaccaggctggagagcagtggcgcaatctcagcttactgcaacccttgcctcctgggttcaagtgattctcttgcctcagcatcccaagtagctgggactacaggtgcacaccaccatgcccagctaatttttgtattttttttttttttttgagacagagtttcgctcttgttgcccaggctggagtgcaatggcgcgatctcggctcactgcaacctccgcctcttgggttcaagcgattctcctgcctcagcctcccgagtagctgggatgacaggtgcacaccaccacgcccagctaattttttgtattttttagtacagacagggtttcaccatggccaggctggtcttgaacttctgacctcaggtgatccgcctgcctcggccttccagagtgctgggattacaggcgtgagccaccaccacgcctggcctaatttttgtagttttagtagaggcagggtttcaccatgttagccaggctggtctcgatctcttgaccttgtggatccacccacctcagtctcccaaagtgctgggattacccgcgtgagccaccgggcctggcctacaattcttatttttaagagtaaaataatccatggaaacttcattgaagaacctaggagtaacaattcaaatcactaagacttctgagatgaaatagttttcctcaggacagccaaatagtaaaacttactgttacaactacttctccacgaggctatttcaaataactcattatttattaattccaaagttaagtgtaaagtttgatataactgctacgttgccaacacaaagaaacatttaacacgaataagctaattacccgatttgatcattacactgtatacatgtatcaaaacgtaactgtattacccatatacataatcattacatgtccattaaaaataataaatgcaaaaagtttattttaattaaaataggaaaataagattacattaaaataactttagactgggagtggtggctcctgcctgtaatcccagcactttgggaggctgaggagggcagatcatgagctcaggagttcaagaccagcctgaccaacatggtgaaaccccgtctctacttaaaatacaaaaatttgccgggcattgtggcacatgcctgtactcccagctactcgggaggctgaggcaggagaatcacttgaacccaggaggcagaggttgcagtgagccgagatcccaccactgcactccagcctgggtgacagagcgagactccatctcataaataaataacttttgtggccgggtgtgttggctcacacctgcaatcctaccactttgagaggccaaggtgggtggaccatctgaggtccggagctcaacactaggctagccaacatggtgaaatcccatcgctactaaaataaaaaaatagcgaggcatggtggtgcatgcctgtaatcccagctacttggagggctgaggtagaagaactgcttgaacccaggaggcggaggttgcagtaagccaagactgcactactgcactccatcctgggtgactgagtgagactccgtctcaaaataaataaataaataaataaataaatatataactgttgctttaattatatgaaattaaagtgaaaactactgaaaactcagtagaaattcacttgaccttaaagtactggaagtgcaaaagaaagcaaaagcaagatttaatatggtccaaattactaaatatcatcaaatttaacagtaccataagctgcaaaagctttttaagagctaaaggctttaaagaagtaaactacctcacagggctcttgtcttttctgaatggacttttgcttcgggaacgtcgtctgctgcaaagttaaaaagtttcagaagttatccaaacaagtacagcatgttagttccttgaaaaacaatttaaacaattcagaagtatgtttaaaaaccttaatttgatgctatgaggcaacccaatctttcctcggatggcactgttaaattttggtccggagctaaaaaggaaacacaaaattacactagttacaggtttagggtcttgctaagatcgcattcatgcgctctccagcaagactaacattgtttaggctactgcttttccacctcagttatgaagaggaaacaaaaatacttgtctcttaactttattcccaggcaagctgcccttgtatttatccatcctggaccactgagaggtgccaagaccaaaggttacagcctcaaaatttttagattctgaaaatgcacacacccattttcagactttagatatctttgtaagctacatatatatatacagtcttgagaattaaaaaaaaaaaaacacacacacacatatataaaaaataaatccctctgaacttccctcacaccagcagtaactatggttaacaatttggtgtgtatctttgcagatcctctcttgggaatctatgtgtgtacatgtacatatacaattttcatatacatcttctttttgaaagacttcttttaaaaactaaagtgaattctttagtcatgcaacttaggtatttccccattcaccagtaactcttaagacagcatgacaccacttaacacactacatacttcagttgtttgttgcaaaaatattccatcgtgaacatgtgaaggtaatttaccaattctctagaaaaattttgtgaggacttgtcaggactaacagagtgttttcacaaagatcataaaggtaattattctgtagtaacagtttttgtgactttttaaagaccaggctaacttaaagggactagccagttgtccattagtgctcatcctgctaacttattccagaagaacagcgaaataaataaatacatagtggcctgtgatccacacatttgaattagttttcatgaacaccatgcctacctacaacatgcaagtatttccaaataaaacactttatattaacttgaccctttgcaattcagactaatgctgatgactgagaatcatttactggatgtattacagttctcaagtaattagttataagctattttctttcccctttaattataaaatattctgagttacagcctcaaacccaacattaagaactaagtaattttttattaaagttaagccatgatcccagcaaacaaagtatccatcactcaaaggaattaagctaattcctttccccttatttagttcatcctggtaaaaagatttaacataatcccattttaaaaatgctcagaatcttgataaatgggacaaaagcagagaagttcctaatgttgtacagcattcgaaattaaaatagcattgtggtcccattttcagctattaaaaagttaatgaaataagcagcttggaggaaaccagcatcacggagtttaattctttttattttaaagataaaagagccagaatcggaattcatgtaatgccaaaacatttcatgaatccattaagtcctctgagcactttacattttcttctcattcattactcattaatagcttatctgaaacttattatctccttaaaaggttagaaaacaaatgcttagcttaggggattaagtatcttgcccaagtgattcgggtctgtttgtctttgaattccatccttaaccattcaaatcttagaagttagaagggttatttttaatatatcccagagtttacagcactgtgtttattaagaggaattaacctcataaagcattaaagattgctagatgcaatccttagaattgtaggtggttaatatagttatttaataaccataatatatttgtttccaactttaaatatccacatccaaatttctagtgatctaatcttcaaaacacttttagtttggaataccttttattattattaacaaaccttaaatacagatgagcccaaaaaaggatctttatcaatgagcatacacaacaaattcacaactggcctgacatttcagctgaaaacagccacggtgacagactttttatttactgttaactaattatacatgtgtaacttagtattcatcagaactttacaattttaagtaaatatgtatttagcaaatactgtaacagcccagacacttgttaagctttcttaggtatttgggcactacaatgtcatctttttcaagcactctagtgctttcatccagtttgcgttgactggcatacaatttagaaactctgatagtttaacagaaaatagtcagtatgcctagtaaaagcaaatttttacttatttgtctatgcactgtattttcactttactagtattcaatgccaatatccttaattcaatactttttaaccaatcattaaaaaaataaaaattcacaattcaaatcactcaagttaaactgccatctgaatacccagagaataaccctcaaaccaaaatcataactatagttacatactaaggacttctgtagcggcctctaaatcttcgatctcgacttcttgagcggctccgtcgcctctctttgcttctacttcgctttctttcacggcttttgctctttttcctttctctgtctctacttcgcttccgttccttacttttgcttctctttcgttcatgactacgacttctgctcttgctttttttcctcctgagaagaaaaaaactcgccattatcatgctggcttaagaacccaccaaaatatactaccttttatggccagaatcattttttcatcctttcataaatttctttggctagttttactatgatacaatggtacataatcatacttaaaaaaaaaaaaaaatcctgtaatctcagcactttggtaggccgaggcaggcagatcacaaggtcaggagttcaagaccagtctggccaatgtagtgaaaccccgtccctaataaaaatacaaaaattagccgggcatagtaccgtgcgcctgtagtcccagctactcgggaggctaaggcaggagaattgctcaaacccgggaagcggaggttgcagtgagccaagatcccgccactggtactccagcctgggcgacagagtaagactctgtctaaaaaaattgctacgtatagtaaacaatatcccttttgccttatattaacattactgaaaatcagcagacaagacattatttgaaagacaccatcctctaagagtagaactgcaattatctcctgagagttagctatagctttaacaagcaaaagggcttgttggcaaatacaaatcaaaatgtgaacctttaaatagtttgtcatacaacaggccaacaaaagcattactgtaatccacaaaataaattaataaaacaaacttacaatagaatattttcacattcaagtactagtactggttcatttataaaaattttcatcaaatatagtaatttaccattaagtcaattttgcccccatttacatatggaaatatttaacacgttcaaagggtcacatagacatcaacattttggttttcatgggcaaaaccgtaatgacaaaggacaataagaactaatgcaggccagtgcagtggctcacgcctgtaatcccaaccctttgggaggccgaggcaggcagatcacttgaggtcaggagtttgagaccagcccggccaacacggtgaaatcccctctctaccaaaaatacaaaaattagccaggcctgatggtgcatgccggtaatcacagctacttgggaggctgaagcaagagaattgcttgaacccgggaggtggaggttgcagcaagctgagaccatgccattgcactccagcctgggcaaaaagagcaaaacaccatctcaaaaaaaaaaaaaaaaacccaactccaagtgcggtggctcacacctgtaatctcagcactttgggaggctgaggaaggcaggtcacctgaggtcaggagttcaagaccagcctagtcgacacggtgaaaacccatctctactaaaaaatgcaagaagtagtgggtcgtggtggcacaggcctgtagttccagctactgtggaggctgaggcaggagaatcgcttgaacctgggaggcagaggttggagtgagccgaaatcatgccactgtactccagcctgagcaacagagcaagactgtctccaaaaaaaaagaaaaagaaaaagaactaacgcattaaaatacaatttgacattcctagactttaatgtgaccatttcaaatacttcctaaagttacaatgaatacaccagaaaatggagtatgccatttttaagccagtttatagaaacctgtgggatgcaatcaaaaccaatgatcaacttgaccttcacagacctttttaaaatctctaactaaaaaccaaaaaagccaaacatatctttctgctcacttccgtagtcttcacagtataccacccattcataattaaatcttataatctatacctctgtgtcatcacccaaattttagaggtgccttcagatatttcaatataaattgaaagacatttcaaaatcagtttattccacgaaaatgtctatttgtagtggcttaatgattaaacattttgacaattctgtatcattatctggatatgtaattgtttattccttatcaaagcaaagttacatatcacaagagcaactgaggtctgcctcagagaacctgtaagcaggtcatctttagagtgcattgaaaatagaaaatgaagacacccaccttctggaatcttgaaacccacactccaatcacaaggagatgtagagctttccaaggaggcagaaagtttgtctaaaatttcaagataatccacctgactgtcagaaatgtatatgctaggtagcacatgacagaaaattaggctacactcattatttatatagaactcatcaaagccatgcccagatgggcaataggtaacactccaattttgttgcctaagaaacctaacactatctctgtgacactattccaactatagaactctgagatttctaaaaccaaaagtcctaaatatattcaattagggaacaaggtaaaaagtaactccatccccctcaaaaacaaagtttttgttctgctctagatgggctatagcaagagaggcaaccaacctatttacctctcataggacccaaaacttattctgccaaaagaaaacacttgaaaattggagagctaattttaacttaaggtcttctaggactttttgtaaacaagtcctcacccacatctgaaggcaaccccaggcaggtaaaaagacagcaacatactaagacattcagaaaatacaatcttttgcataaaagcccagagaaaactacaagggtgcaagaaaccagtatatttccagcttcaaagagcatttattacattaactaaagaagggttatcgaaatccacactaatagtcaaatcctgttacaacttaaaagggactttccaaagtctttaatggcagtgaaattttgtactgaacatcactgaagtaaatggtccactgggctgggcctttggactttttggttatatggcctctgcagtaaaggtgttttgctataactggatttgacctcttccatgtaagaagatctaaatttttaatgcaaagtattctggaaaataagaaaaaaaatagaaaagtcatttattccaaaatttatagataatccacaccacagtagccaatatatttcaactgtgtcattttaatgttatcttttattgagtaattctctaaagagcttaacggaatggacgctgatttagactttgcaaaactggttactttaacaaataatattcccatgagggcaagctcaagcacttaggatgcataccttgacatatgcaaaaactcaggtttacagctcttcagaaaataggttgacaaccagtctgtgtcacaataactttgttccttttactattctaggatactatgaagtgtatgttaagaatcagaattatacaattaaaaaaatttatactcagtcaactgtttctcagaacatgccatttttctactacctaacaaactatagctcaatgtggcttttaagacaatgaagttttagaatgaaaaatgcaacacggcactttcctttggttaagaaatttaatttagtactaaaggtttaaagcagagtgttctgtatgttttatatctattcctaaatacaaaaattttcttccaggtaactttaaaattaatttgaaacataaagttccttcagaaaatcaagagtcctgattgaacaagggaatcatttatttatcacctataattgacgagaagtctgactggaaagtattttaagattaccaaagtgttttgaaaggatcttcccttagacaatctcatggttaaagaaaattgtccattctcctatttagtcctgtggttctctacattagacaaaggccaccgaatatcacacatggagaacttgatgctcagcttccttgtaaaagcttgtagccttaatcagcttatacacaggataaaaacaagtagacaccggagatgaccttagtggcaaaaagcgacatgagacaatggtacagtaacgaaggtctgtacccaaaagtgtacgttcttatccttctggcacttgaagcgaaatctttagccactcggcctgacacctaaattggataatttatgtcaatttatatggatacaccttcctgggttttcttttgattagagaattgcaaaacaaaaacattaggaaaccattactgtggcagaaagtctaaaaccagatgacataaaccatacctctggttggttgcatcagatcccacatcaagactaaacccaacctgatccccacaatttcttgtgattggtgaggaactataaatgactcccatccaagcttataccagaaaaaaggagcacattttctacaaattatatcatttttaatccattaccacattattttaggggaactacaaaaaaaaaaaatagtggcttaacaagccctgaataacattatatattttctcatctgttttatgaaattttatcaacctacctaacacagttgtagtgagaaagactgacatacttactatgaagcatttagggatcttaggaggaaaagagccaaaaagaaatcaaataaatggctatttttctctcgtttttcattaacataaggtcgtaagtatgacagatttttatgtttgtttgagacggagtctcgctctgtctccaggctggagtacaatggcataatctcagctcattacaacctctgcctcccaggttcaagcgattctcctgcctcagcctcccgagagtagctgggactacaggcgtgcaccaccacgcccagctaatttttgtatttttagtagagacggggtttcaccatgttggccaggatggtctcgatctcctgaccttgtgatccacccgcctgagcctcccaaagtgctgggattacaggtgtgagccaccacgccaagcccagactttttttttaagacggagtctcagttgggtccatgtctcacgcctgtaatcccagcactttgggaagccaaggcgggcggatcatgaggtcaagagatggagaccatcctggccaacatcgtgaaaccctgtctctactaaaaacacaaaaattggctgggcatgatggctcacgcctgtaatcccagcactttgggaggccaaggcaggtggatcacgaggtcaggagttgaagaccagcctggccaggatggtgaatccccatctctaccaaaagtacaaaaattagccaggtgcggtggcaggcacctgtaatcccagctgctcgggaggctgaggcggaagaatcgcttaagcccgggtggcagaggttgcagtgagccaagactgcgccactgcactccagcctgggcaacagactgaaactccatctcaaaaaaaaaaaaaaaaaaaaattagccaggcgtggtggcaggaacctgtaatcccagctactcgggaggctgaggcaggagaactgcctgaacccaggaggcagaggttgctgtgagctgagatcgtgtcatggcgctccagcctgggtgacaaaaacgaaactctgtctcaaagaaaaaataaagacagaggctgggcacggtggctcacacctgtaatcccagcacttttggaggccaaggcaggcggatcacaaggtcaattctggctaacacaatgaaaccctgtctctactaaaattacaaaaaattagccaggcatggtggcaggcgcctgtagtccctgctacctgggaggctgaggcaggagaatagcatgaacccaggaggcggagcttgcagtgagcagagatcacaccactgcactccagcctgggcaacagagcaagactccgtgtcaaaaaaaaaaaaaaaaaaaaaaaggccaggcgcggtggctcacacctgtaatcccaacactttgggaggccacagcaggaggatcatgagaggtcaggagatggagaccattctggctaacacggtgaaactccctctctactaaaaataaaaaaaaaattagccaggcgtgatggcgcgcgcctgtagtcccagctaatcggaggctgaggcaggggaatcacttgaatctgggaggcagtggttgcagtgagccgtgatagaaccactgcaccccagcctgggcgacactgccagactccatgtcaaagaaaaaaaaaaaaatcaaagaatcacttgaacccaggaggcggaggttgcagtgagcccagactgcgccactgcgctccagcctgggctacagagcaagactccgactcacaagaaaagaaaaaaaaaaagtggatctcatcatatctgttacctaagacttttcgtacactgttttctgtactagtctatagcagagttctattgagtcactcatcttacccaaataaagtgtacagatatattcataatttccaaaatccccaccctgttaagtctagagtttaaaaggcctaagataatgaaagccacctttagaagtacttaagtacctgttccatcacttccaaaagggcctctgagcagcaagttgcagaaataattcacagctttgactccttcggcactttagggcaaacaatactttccatggcctagttatcacctaatttaactctttctaccttttaagatcaatggatatataacagttttatcagtaagataaccaaatatcaaaccaaagttaacaaatttaaaacaagacaacctctaatacagaacttgtcaccagattgtcatgatggacttggaggggaaggtatctgaaactatattctgaaatctaagcaaaaaaatccacagttcctccaagagtttgtctcaaaaggcaaagaaccaattttctaaaagcagcaaagaaaagcttcagaagagaattttgtatactttagccacaggaacacaacttaaggtctaaaaccacaaaaaagctcaccaccctcccccaagccccttcttaaaactcactttttgctacgttcttcatggccgttggcactgctcaacttgttctcatcctaagcagggttgatagaagaacatcatgaggacgaagtggtaacatttcaagttgtcaaagggtaaagggaacaggaataagaaaatacaaaacaattttaaaactaattatttacttatagtttaacatggaaggctataaaaaaatttagatgggtatgtgtttaaccactttgttgcttacatttaagtcatcaagatacaaaaataaaaaaattttccatattaacatgttaaattttactttcttatatagtttagatattaaaagttatccagatttacaatgttgaagtggttaaatataatttccataaaacatgaagtcctgttttgagttttattccatgtgctatggtccctttggtcagtaccatggctctatttctgcctaagccccaagtggccatgctagcagccagccactatcgatttcctgtgaccgatgccattcctgagatcttcgcccatttccgttggagggttgggactgtaagagcttgatgccacctctgtcacacatctcgccctgaagcaaacagggattcacactgctttagtaatgttgactcccaagaacccaagaaagtcaattaataatccaccaagtccagcctaaacatttcctacttccatacctgtttacatggaattacatccatgttaaaaaaaactaagacacaagaatcttaacattaaaacagaaagtagctcttcaagagtctaagcattacaaaattacatacactatttaaatctatcaagaattcatccaaattggtaccacatggtcgtgctatacaatccaaaacaaatgtattatttttaaaaggtttagtgaaatgtttattttaaagtttgattacatcagctataggagtaaagtgctaacttacaaagcttacagtttgtgacaccagtgataatgcatgcatactgctattttcaccaccaactggtgaaacaatgaaaagacagtttacttttactgagataccgaaatgagtcaaagactatattagccaatataattcctttgtttttagtgtgaaatactatggtagggcctaattaaaaataaaaacaatatggagaacagtaaaacagtcatcaagtgactctaagcttgtatttactctaagcttgtattaagcttgtattgactctactgcctcttgtattttttttttttaatttctattcagggatccaagaattttagtaattattaactgagcagcagattgccactggactgttttaagatttactatcaccagtcttacatagatacataaattttaaaatctcacccatttcttcttataagactgttagaagatttaacttgccacagactggtcatgctttgttattcttggacccctgctttttcccaaaccactacattcacctttttgctataccaaactggaggtggtaattcttagttgagtcattttacctaggggaccacggtacagcgataagtcactcaattactaccttatgattgacagttcacactggaatcaaaggtgaattcatgggagtagaggtgagatatcgttaggcaagtctacaaagagagatagatgggcatttattcatcacgctgaagtgaaactactgcacaatattattacatcaatagcatatatttacttttgtaagttacacgtaatgcatctctgataagataaatcaagagggctccggggaggttagtttacatttcagcagtagtttcgtgaataatgctaaattaagaaatatataaacctcaccgacatgttttttctcaccttcttgtaaggagcctcaagcattgcttcaatatcaatatcgtctgccattttctctaaacgcctaggaagagaacaagacaatttcttgagtaaacatttctcttacaatgtgaaacaagtttcactcttgttgcctatatcgtctaacattttctctaaacgcctaggaaaagaacaagacgattccgtgagtaaacatttttctttttttttttttttttttttgagacggagtttcgctctagttgcccaggctgaagtgcagtagcgcgatctcggctcactgcaagctccgcctcccaggttccagcgatcctaccacctcacctcccgaatagctgggatcacaggcgcctgccaccacgcccggctaatttttgtatttttggtagagacggggtttcaccatgttgatgaggttggtctcgaactcctaacctcaagtgatccgcctgcctctgcctcccaaactgctgggattacaggcgtgagccaccgcgcccggcctggtaaacgtttttcaaatcgactgaatttttcttctcagccgacacactcgaaaacttaagaaaaacctccaaaagccctacaattaatgactaaagtgacatgcactttaaccaggtttggcttacgtaagtaaatccaaaacgcctcttacacgaaacacacgaaaatgaagacttcaatatccaatatttaaaactctgctgtcaactccaaaaacagaaactgggagacccgaacgagagcgcctctttccgggcaaaaacccgcgctgccattttaggggcaaagagaaactccctccattgggaggggttatgagccaaggcagcgttcaactggcgccatgttgggaggtcgcggccggcccaggcctcgaaggagacaggtcaccattctaccgcggcctctcgggggtccctaccgccccaagaatccagactatacccgactggaaaataagggcgcggtcactgaaacagggccgatttctcgaaaaccaccccccaccccggtcgctaaagacctccaaaagcgcccctcagcccaaaatggagccaaacctcgagaaagctgagataatacgcgggtccgcaacgccccgtacctgttccggccttcgggcgcctgtggtgctcgtgttcgggaagagattgctgctgctgctgctgctgctgccgccgccgccgcttctgttgctactgttaagcccctaggcccaggccgcggaaccgcccagcccgaatatcgggttccaaggacggctaggcccgagagaatctaaaaaaaacaatggaattagagaagcccacgcgggagagcaggacggcggcttcggcagctcaggatccacccctgcgacagcgtcgacaagctccctgaaatggcggccgctgcttccctgtactcacattcaccagcacacatacacacacacaaacacacggggcctcacagagccctcagcacgggctctcgcgagaagctgccccaagctccaaatttgagcggccgaagtatcgcgagacctaagtatggctccggcgaccgtagcccaatctcgcgcaatgattgcgccacagatattcccatcccccattcagtgaggcgcctttcactccccctccgcgtaagcacccaaatctcgcgagacagagcgggtctctagggcaaagacagttggtaggctgcctgtcaatctttcagagagctcttcgctgagtggagctcagcggtcacctccccctcgtggcgcctcctcacggccatctgaagattcctccggcacagccgatcgcccccgctccggcctcccacacagatggctgtcaaggtcgccataaggcaacctagtccttatggcgataggataaaacggccatattcagattatccgctgagggtggagaggaagtggaaaagtgtatcagaaggccagaagaagagatctttaggggtagggggagagggggagataataaaaatagatttccctgtcatttggagccaatggcgcggcctccactgtcgagctttgaaacaaccttggaaatagtggagaaaagcaaaaaaaaggtggaaaaaataaactcttgcttcccttggcatgggatcagttttgtgccccgaatttaatcagctcttgtgtcagggttgctaccgttccttcaaaaatgttccccttcctgaatattactggacgatttggtgaaaaaataagacacccccccaacaaaaaaaaaaaggcccccttccccctgggacctggctcctctcccctgaagtcttctagatgccaggtaattagagtatgaattagccatttgttctttggtcagtactgtgtgaggtttcctcctagatgctgggaaaaaaaactggaaagaagtcttcaaagcaaaaatcttaccctctaatcttaacagtctaatgattgagggcagaaaagattggaaatgagacgccttgattagtgtaactagctgctgcaacactgtgtgaccttggacaagcaaattaacctctcagaggggatctttcatttcctgatttaaaagaggacgtacttagtagctagtctaagctacttgagactgaggaaggcaggtaatgctcagtactgaatttttagaggttagcagggcatgtctgcccaagtggaccctcagtaaattaatgaatgaaggctcagaagggctatagtgaagattaaatgatataatgtctgtaaaacgcctggtaaatatttgatcttcaaaacagctaacttctgtttctgctaaacaaaattatttagagcaaatatagatgttaagtggttttgcctctcaggttaactttacacacaggttaggatttatcttagaggattattaataacagttattttgtagttagaatactcccttaatcctttttctgaaaattcagatcctctttttattttatttctgagacagtctcgctctggaggctgggcgcagtggctcatgcatctaatcccagcactttgggaggccgacgcgggtggaccgcctgaggtcaggagttcaagacctgaccaacatggcgaaaccctgtctctactaaaaataaaaaaaaaactaggtggcaggcgcctgcaattcccagctactcgggaggctgaggcaggagaatcacttgaacctgggaggcagaggttgcagtgagctgagatcatgccattgcactccagcctgggtgacagagatcgagactccatctcaaaaaaaaaagaaagaaaaagaaagaaaagaaaactgtcacaggaaattgaagcataatatgtcagaaataaagcaagctaacctttgctatctcttcctgcccctcggtaattccagtattatgactagtgcaaaatgaaagcatgaagatggcacttggtttttcttgtttgtttaggaacatgacatgacagaatttgaccttaaccgctagacttcttgtttgggaagaggaaggatttaagctctaagtcgcttgatgatttaaggtcccttaaatagttttctgctcaaggaccatcagaggcaatatggcaacttagcagatcatcaagaaaagccgtttggaaaaatcaagtttctgaaacaagtattttttatgtttaaaagaaaatatccccaggcatggcggctcatggcctgttatcccagcactttgagaggccaaggcaggaggattgcttgagtccaggagtttgagaccagcctggacaatatagcaagaccctgtctctacaaaaaatttaaaattagccagacgtggtgatgcatgtctgtagttccaactactcaggaggctgagatgggaggatagcttgggcccaggacttcaagactgcagtcagctagaatcacgtgccacttcaccccagcctgggctgcagagcaagaccctgtctcttaacacaaaagaaaatatcacgaacataagatgcttctcattcactttacaaaacttcactaactctggttcatgaactttctatgtaaattaattcccctttcatcattttgctttcaaaagatggaggaatagagcttgaaatagagccaaaaaggtaatgaatatacttagagaatttggctgaaaactaaatgtattttaccaatgtggatttttaattttttaattattaagggtacattttaaatgtatatgtttatcagatacatgtggtttggttttgttttgttttttgtccccaacaatctacagcaagtagaattgtttcgttttttaattgagacagggtctcacactgtcccacaggctgaagtgcagtggcaacatcatagattactgtaaccttgcattcctgggctcaagcaatcctcccagctcagcctcccaattagctagaaaaacaagtgcacatcaccatgcccagcttaattttttaaaaattttttgggctgggtgtgatgacttactcctataatcccagcactttgggaggccgagataggtggatcacctgagattgagggtttgcaaccaggctgaccaacataaagaaaccccgtctctactaaaaatacaaaattagccaggcgtggtggcgcatgcctgtaatcccatctatttgggaggctggggcaggagaatcacttgaacctgagaggcggaggttgcagtgagccgagatcacgccattgcactccagcctgggcaacaagagcgaaactctttctcaaaaaaaaaatttttttttgtagagatttgggcttcaaatgtgatgttttgataaaggcatattatgtgtaataatcaaatcagagtaattggggtaatccatcacctcaagcatttaacatttcttttctttttttttttttttgagacagagtttcactcttgttgcccaggctggagtgcaatggcgcgttcttggctcacgctctctctctctctctatatatatatatgtgtgtgtgtgtgtgtgtgcatgtgtgtatatatatgtatatatatatatttttttttttttcgagatggagtctcgctctgtcgcccaagttggagtgcaatggcacaatctcagctcactgcaacctccgcctcccaggttcaagcaattctcctgcgtcagcctcccaagtagctgggattacaggagcatgccaccacacccggctaattttttgtatttttggtagagatggggtttcatcatgttacccaggctggtctcgaactcctgacctcaagggaattgcctgcctcggcctcccaaagtgctgggattataggcgtgagccacctcgcccggcctttttctttcttgaaacagtgtcactttgtcacccatgctagagtacagcggcaaaatcacagcttactgcagccttgacctcctgagctcaagagatcctcccatctcagcctcccaagtagctgggactacaagcacatgccaccaggcccaggtaattttagtattttttgtagagttgggtttttgccatgttgtccaggctggtccccaactcctggctcaagggatcctctcctctatgcctccttaagtgctgggattacaggcgtgagccagcatgcctgaccctttttttttccccatatcactaggacaatgggaaacttaagcccatttcatatagatgtaattaattttaacactcatgtgacctttgcctgatttaggcagatgaaattgtatctccccacccaggttccttctgcacttgattatctcatcaatctactgactgattgaattgttttaaatacttgcctgtctattggcacaatgtcaagggtattctagtgacatatccaaaggttttaacttaaatttgtgaatcatgttttttgagacagtcttgcaccatctcccaggctgcttggagtgcagagacttagttatggtttacatggtttactgcaggctcaaactcttggcttagcttcccgaagtgaatcattaggttttttttttttttttttgagatggagtctcgctctgttgcccaggctggagtgctgtagcgcaaccttggctcactgcaacctccgcctcctgggttcaagcgattctcctgcctcagcctcctaagtagctgggattacgggcacctgccaccatgcctggctaatttttttgtagagatggggtttcaccatgttggccaggctgtttttgaattcctgatctcaggtgatccacccaccttggcctccgaaagtgctgggattacaggcatgagccaacatgcccggcctgttgcttgttttttttgagacggatactcactcaatccacccaagctggagtggagtgcagtggcttgatctcagcttacttcagtctccttctcccaggttcaagtgattctcctgccttagcctcccaaagcagcgggaccataggtatgcgccaccactcccggctaatatttgtatttttagtagagacggggtttcaccatgttgaccaggctgatcttgaactcctgacctcaggtgatccgcccactttggcctcccaaagtgctggtattacaggcgtgagccaccacacccagcttggttttttgtttttttgaaatagtctcactctgttgcccacgctgcagtgcagtggcaagatctcagctcacagcaacctccacctcctggattcaagcaattctcatgtctcagcctcctgagtagctgggatttcgaccaagtgggcccaggtaatttttgtattgttagtgcatatggggttttgccatgtcgacccagctggtctcaaactcctggcctcaagtgatcagccctccttggcctcctaaagtgctgggattacaggtgtgagtcgccgtgcctggcagaatgattagtttttaagaagaaatctaggccgggcgtggtggctcaaacctgtaatcccagcactttgggaggccaaggtgggcagatcacctgaggtcaggagtttgagaccagcctgaccaacatgatgaaatcccgtctctactaaaaatacaaaaaattagcagggtgtggtggcgggcgcctgtcatcccagcttctcgggaggctgaggcaggagaatcacttgaacccgggagttggaggttgcagtgagccgagattgcgccattgcactccagctcgggcgacagtgggagactgtctcaaaaaaaaaagaagaaatctttcaagggtacatccctggccacttacttgaggttgataccacattaactttgcttgggatcactgtcaaaaatcctgtcctcaaactcaagataatttcgttagatccgatgtgaactagatagggaaataactgatgctttctgtcagagtttcatctttggtcaaaaaagtaaaatgttttgaactcatcatagttacggcaatgaaaaaaattaaggggcactcataatagcccatgtgtccattccatggccaaaaggattgcccaaaatgctactttagattaaaaataaaagcaaaaagattcaatacacggtaacataaaatgtaatttacggccgggcgcggtggctcacgcctgtaatcccagcactttgggaggccgagatgggcggataacaaggtcaggagatcgagaccatcctggctaacacagtgaaaccttgtctctaccaaaaattcaaaaaaattagccaggcatggtggcgagtgcctgtagtcccagctacttgggaggctgagacaggagaatggcgtgaacccgggacgtggagcttgcaatgagccgaggtcatgccactgcactccagcctgggtgacagagcaagaccctgtctcaaaaaaaaaaaaaatgtaatttacaacactcatttagagcttatcagtgaaatatactgtttactgattcattcagtgtttatttagtacattaggtaggtgaaatactcattaagacaatttgtggccaggtgccgtggctgatgcctgcattcccaggactttggaaggctgaggcaggtggatcatgaggtcaggcgttggagactagcctggccaacatagtgaaaacctatctctactaaaaatacaaaaaattacctgggcgtgctggcgggcacctgtaatcccagctatttaggaggctgaatcccttgaacctgggaggcagaggttgcagtgagccgagatcgcatcactgcactccagtccaggcgatggtgcgagactccaattcaaaaaaacaaaagaaaaaaaaaagaaaatttgcgagcccacagctaatcaaaaggataatcctttttccttcaagggtttccagtttattgagaacacctgaaggaatgtaaaaccatattcaagatactgttttgcattgtactaataagattttgcataaactcaatgctttaaacatcaaaagtcagggtctcggccaggcacggtggctcacacctataatgccaccactttgggaggccaaggcagaggatcacttgaacccaggagtttgagaccaccctggtcatcatagcaagaccctgtctgagaaaaaagatggagtctggcagtgtcgcccagcaggcattgtttggtggcatgatcatagttcattgcagcctcaaacacctgggctcaagagatcatcccacctcaacctaccaagtagctaggactacaggcacacgccactacacctggctattttttttctttcatagagacaggatctctctgtgttgcccagcctggtcttgaattcctggtctgaagcaatcatcccacctcagcctcccaaaatgccgggattataggtgtgagccacctaacctggctaatagtattaataatagcatatttacataacacttcacacattataaacctttttctatataaaaatcccatttattcctctatatcagtttatttcctttttttttttttttttttttttgagccagagttttgctcttttgcccaggctggagggcagtggtgcgatcttcactcactgcaacctcctgggttcaagggattctcctgcctcagcctcccaaatagctgggattacaggtgcatgccaccatgcctggctaatttttgtatttttagtagagacggggtttcaccatgttggccaggctggtctcgaactcctggcctcaggtgatccgcctgcctcggcctctcaaagtgctgggattacaggcgtgagccaccgctcccagccttgtttatttccttgaatgaaatacattgaaatgatcagactataatggaagtgatcacagaatctgcttctgaaagtagctgatttatgtattttatcagagcagttagggagatttttttccaacattttattatgaatattctcaaacagaggttgagagaatagtacagatgcccaccatctattttacgtttaacatttttcaatgtttgctatatcacatattcatctatccctttgtccatccattcatccaacctaatttctgtgtgcttttcaaagcaaattgcagacatcagtatactttatttctaaacacttcagcattgcataatcttaactagagttttttttttaatcttaactagagtttaatagtgttcacaatatttttaaatgacataatatttacatatggcaaaacacacaaatcttaaatgtaccaatagattagttctgacaaatgcttacaaatcgggtaatgttctgttaactttattaagtaaagaaatagcagacacaggcacagagggtcagagaaagcagtatattttgtcccaaaatatcctgatttgacaaccggagaaatggataaaccattgcaaattaggaggcagagtattgtttaaaaacatctgctaacagaagcaaaaataatgcagtcgggcacagcattgcaaaagatttaggaattaagcaaatctagcaatagagaggaagattctgctgacaaggcatcacatgatggagatataccttgaaaatgaaggatggcaaacaaaagaagcatcaactcaatagtggttttgaatgaaaggcatgtgatttcatgatatgaatgaatgaccttgtacaatgaatagcccagaaagacacagcatctctgaaaggatgtagctaataaactcattcttttggggtctgaaaaaaataggttcttaacagtcattttctgtaagaggtctacagacatacatcttgcccaaacatctctaaataaccagctccctagcctacctaggtggcaggaacctgtaatctcagctactcaggaggctgaggtgggaggacttcttgagccccggaattcatgtacagcctgggaaacacagtgagactccatctctaaaataagtgaaataaataaccagatgccatctcaatatataaatgaaacatcagagttggaatatgtgcatcatagacatgaattgtatgctattgttgtaaaggagcaagggatgccgggcgcagtggctcaagcctgtaatcccaacactttgagaggctgaggtggggggatcacgaggtcaggagttcaagaccagcctgaccaacatggtgaaaccccatctctactaaaaatacaaaaattagccaggcgaggttgtgtgcacctgtaatcccagctactcgggaggctgaggcaggagaactgcttgaacccaggaggaggaggttgcagtgggtggagattgcgccactgcactctagtctgggcaacagagtgagactccatctcaaaacaaacaaacaaacacaaaaaaccaacatgggattttggtaagaatgtggagaaattggaacccttatagtttattggtatcaatgtttacatattaatgatatagctgctatagagaacagtttggcagttactcaaaaagttaaacatggagttactctatgacccagcaaatacattcctaggcataacaaaataatttagaacagacatttggctgggcacagtggttcatacctgtaatcccagcactttgggaggctaaggcgggcagatcacttgaaaggagttcgagaccagcctgatcaacaaggtgaaaccctgtctctaccaaaaatacaaaaattagccaggcatggtagcgtctataatcccagctacttcggaggctgaggtgggaggatcacttgaacctaggaggtggaggttgcagtgagccaagatcacaccactgcactccagcctgggagacagagcaagactccatctcaaaacaaaaaaacagacagtcaaataattactcatacacaagtgttcatagccgcactgctcaccatagccaaaaaatgaaaacaacccaaatgcctaccaactgatgaatggataaacaaaatgtagtatattcagacaatggaatattattccgccataaaaacgaaatactgatacatgctataatgtagatgaaccttgaaaacactatgctaagtgaaagaagccagacacaaaaggtcacgtattgcttgaaaccatttatatgaaacatccagagtagataaatccatagagtcagaaatcagattggtaggccgggtgcagtggctcactcctgtaatcccagcactctggggggctgaggtgggcagatcaggaggtcaggagatcaagaccatcctggttaacacggtgaaaccccatctctactaaaaatacaaaaaattagtcgggcgtggtggcaggtgcctataatcctagctactcaggaggctgaggtaggagaatctcttgaacccgggaggcagaggttgcagtgagccgacatagcaccactgcactccagcctgggtgacagagagagactccgtctcaaaaaaaaaaaaaagaaaccagattggtctttgccaggagctggagggaaggaggaatgtggggtgactacttaatggctataaggtttcctgttggggtaataagaatttaccagaactagatccacctagttaagagttccaggtagtggtagcgatagatgctctggatcgagttgtaaagcccaaaatgaaaagagtcaagagattccttgagaagagagaaccaaaactcaatgaaaatattaaaaatgcaatgctgattaaagggggaaatgcaaacgcaacagtgacacaagtacttaaagatgtgtgtgcactgaaaaaaccatacggtgtactgtataaaaagaaaaatgttacaagaccttttgaggatcagacatcactggaattactttcaaagaagtcagattgttctttattcatgtttggctcctataataagaagcggccaaataatctagtaataggtcatatgtatgactaccatgtgctggatatgattgaattaggtattgagaattttgtctctctaaaagacattaagaacagtaaatgtcctgagggaacaaaacccatgctaatatttgctggtgatgatttcaatgtaacagaagattacagaagactaaaaagtcttcttactgatttcttcagaggccccacagtatcaaatatctgcctggctggattagaatatgttctgcacttcactgcactgaatgggaagatttactttcgaagatataagttgctgttgaagaaatctggttgcagaacaccacggattgaattggaagagataggaccctcattgaatctggttctgaggaggacacacctggcatccgatgacctttatacattatctatgaaaatgccaaaagctctcaagccaaagaagaagaaaaatatctccaatgatacttttggtacaacttatggaaggattcatatgtagaacgaagataagcaaactacaaaccaggaaaatgaaggggttgaagaagtgacctgcagaaaggataacagaagaccaggagaaaaagtcaaaaagaatttaaaagaaattatggaaaaaaaaaaaaagaatttaccagaactagacattggagaaggttgcacaacattgtggatgtaaatgccaagaattgaacactttaatatgattaatggttaattttattttatgtgaatcttatctcaataaaaagagaatagactgggtgcagtggttcatgcctgtaatcccaatactttgggaggccaagggggaggatggcttgaaattaggagttctcaaggccagcctgagcaacagagaggaaccctatctttttttacttgttgttgttgttgtggttttgagacaagggtcttgctctgtcacccaggctagattgcagtggcctggtatgattgatctcactgcaactctgcctcctgggtataagcaatcctcccaggtgtggctgggatgacaggtgtatgccaccatgcccagctaatcttcatgtcttttttggtagagatagggtttttctgtgttgccaaggctggtttcaaactcttgggctcaaacaatctgcctaccttggctgcctaaagtgctaggattacaggggtaagctacctctcctggccttgaccctatcttaaaacaaaaacaaaaacaaaaacaaaaaaacctagcagggcatggtgacatgcacctgtagtcccagctacatgggaggacgaagtgggaggattgctggaacccaaaagtttgaggtggcagtcagctatgatggcactgctgcatttcaccctgggcagcagattaagaccctgtctcctaaggaaaaaaaaaaaagaaagatattttaaaaaaaggaaagaaacaagggaccttctcagaacctctagaatcaagagcgagatgctggatgatcaatgaaatgaaaaccctcagccaggcgcaatagctcacgcctgtcatccaaacactttgggaggcagaggtgggcagatcatgaggtcaggagtttgagaccagcctggccagtatggtgaaaccccgtctctactaaaaatacaaaaattaggtgtggtggcgcgtgcctgtagtcccagctactcgggaggctgagacaggagaatcccttgaaccctggaggcagaggttgcagtgagccaagatcgtgccactgtactccagcctgagtgacagagcaagactgcatctcaaagaaaaaaaaaaaaacccacacacaaaaaaaccaaaagagactcaaatccctgctttcttcttcttcttctttttttttttttttgagacagagtcttgctctgtcgcccaggctggagtacagtggcgcgatctcggctcactgcaacccccgcctcctgggctcaagccgttcttctgcctcagcagcccgagtagctaggattacaggcacgagtcaccacgtccagctaattgttttctatttttagtagagacgggtttcaccatgttggccaggctggtcttgaactcctgacctcaagtgatccgcccacctcagcctcccaaagtgctgggattacaggcatgagccactgtgcccacccaaatccctgctttcaaatacccacctcttctcatgtcatggctacattctgcacttgcagaatattgaagtaattccatatatatatatatatatatatatatatatatatatatacacacacatatatatgtatatacatatacatgaatatacatatacatgaatatatgtatatacatatacatgaatatacatatacatgaatatatgtatatttacgcatatatattatatatatttactacatatgtattttatatatatacatatatatatattttttaattgagacggagtctcaatctgtcgcccaggctggagtgcagtggtgcaatctgggctcactgcaacctctgcctcctgggttcaagcaattctctgcttcagcctcctgagtagctgagattacaagcccccaccaccacgcccagctaatttttttgtatttttagtagaaatgggtttcaccatcttggccaggctggtcttcaacgcctgaccttgtgatccacccgccttggcctcccaaagtgctgggattacaggcatgagcccccatgcccagccatatattctatatgtatatgtgtggcagtctactatgtgccagtcactaaactaggcactggtaaaacaaacaatggagtgcaaaaaacagtcatggcccctgccctcctggagctaacaaaccttcttggaagaggcaggcattgatcaaaagactatatgaatagggctaagcacagtggctcaggcctgtaatcccaacactttggaaggatgagccaggtggatcacctgaggtcaggagttcaagaccagcctggccaacatggcaaaaccctgtctccactaaaaatacaaaaaaattagctgagcatggtgacacatatctatattcccagctactcaggaagctgaggaaggagaatcccttgaatccaggtggtggaggttgcagtgagctgagatcatgccactgcactccagcctcgtagacagagcgagactcaaaaaaaaaagaaaaaaaaagactatataaataaatgaagatgcacaactgtgacaattgctataagagacatttatggtgctataagagcaaataagaggaagatttgggccaagctcggtggctcacaccggtaatcccagcaccttgggaggctgagatgggctgatctcaaaaaaaaaaaaaaaaaaacaaaaaaaaaaaagtaagatttgaggagcagcgtataacaggtaaagaatattcctggcaaataatagactgtgcaatagccttgcagcagaatgaagcatggtgtctttaaggactacaggaagaccatgtggctatagcaaagatgcttaggaagagcccaaccatgtaataccttctaagccagggaaggtgagtctggtttgttgttgttgtggttgtttagatggagtcttgctctgtcaccctggctggagtgcagtggttagatctcgactcactgcaacctttgccccccgggttcaagcgattcttttgcctcagcccctccagtagctgggattacaggtacacaccaccacacccggctaatttttgtatttttagtagaaacgggtttttactatgttggtcaggctggtctcgaactcctgacctcgtgatccccccgcctcagcctcccaaagtgttgggattacaggcgtaagccacacgcctggcctaatttttatttttatagacatggggcctcactttgttgcccagcctgatcttgaactcgtgggcacaagcaatcctcccaccttggcctcccaaagtgctgattacagatatgaacctccatgcccagcagttttttcaacacttacagaactagtctcattgcctcttcttcagagataccagcacctggctgcccaatgccccatactcacaagtctggtttctaccccttggggttcttcctctgagttcagagacacgagcacctgtcaatcaatacctcctcctcagaggtctgagtgtcggctgtgtttggccactccccctctaaatttctatgttttaataactccaacctcttccttttgttccctcagccctaggggtggtagctgttcctacagttactaccaccatgaaactttaggtttcgccttttacttcttcagttacttagttaacaatccactaagttacactgtctctgtccaaatgccatgtgatttctacctccttacaggaccttgactaatatataaggattgttatttatccttcaaggtccagttcaagtgctgccttctaatgtgtcttttccattatcctcagttaaaattatccatccagttaattcataatgtctttcttgaaaagccaataggcgtttgtttttataattatatgcccagtcacactcatatgcctactcacatctctttgttgtcctacagttatactgaaacttctttactcaaattaactctgatccaaaaaaattgcctaccaattataatagagaagagtaggtatagagcaagaaggaacaaacatgggttctaatccattcaattacataatgtaattctgcacagtttacttaaactctcagttaaatttgtttctctagcctcacagacggctctgaggattaagtagaataaatgtggaaaggattaagtaagataatatgtgtgaagcatttaccacagtgcctgtctaatgccccaagtattcaataaatataaactattggccgggcgcggtggctcatgcctgtaatcccagcattttgggaggccaaggcgggtggatcacaaagtcaggcattccagaacagcctggccaacatggtgaaacccgtctctactaaaaatacaaaaattagccgggcatggaagcaggcacctgtaatctcagctactcgggaggctgaggcaggagaattgcttgaacttgggaggaggaagttgcagtgagccaagatcgttgccactgcactccagcctgggcgacagagcaagactccatctcaaaacaaaacaaaacaaaacaaaaagagttatgctgagtcttctctgcctatgttctataaatggaacaataaagcctggatgacagcacatctgtttacaacatagtttattgaatatttcaagcccactgttgagacgtactactcagaaaaaaaaaaaaaaaaaaagattcctttcaaactattactgctcattgacaatgcacctggtcacccaaaagctctcagggagatatacaaggagatatacaagatatacatgcctgctaaaacaacattcattctgcagtccatgaatgaaggaataatttggacttccatgtctttatctttatttttaaaaaatgtttatttttatttctatttatttatttatttatttatttatttttgagacagaatctcacactgtcgcccaggctagagttcagtggctcgatctcgctcactgcaacctccgcctcctgggttcaagcgattctcctgtcttggcctcctgagtagctgggattacaggcgctcaccactacgcccagctgatttttgtatttctttagtagagatggaaattcactgtgttggtcaggctgatctcgaactcctgtcttcaagtgatctgcctacctcagcctcaataaagtgctgggattacaggcgtgagtcactatacctggcctttattttttattcctcagcgatttttatatagagatcaggtcccactatgttgtttaggctggtctggaacacctgggctcaagcaattctcctgctttagcctcccaaaatgtaagccaccatgccaagcctgactttcaaatcttattgtttaagaaatacctggccgggatacctggccggggccagacctggtggatcacgcctgtaatcccagcactttgggaggcagaggcaggtgaatcacctgagatcaggagttcaagaccaggctggccaacatggtaaaacaacgtctctactaaaaatacaaaaattagctgggcatggtggtgggcacctgtaatcctagctactcagtaggctgaggcagaagaattgtttgcacttgggagaaggaggttgcagtgagccaagatcgtgccattgcactccagcctgggcgacaagagcaaaattccgtcaaaaaaaaaaaaaaaagaaggaaggaagaaagatagatagatagatctggctgggtgtggtgcctcacacctgtaatcccagcactttgagaggctgaggtgggtggatcacctgaggtcaggagtttgagatcaacctggccaatatggtgaaacctcgtctctactaaaaacagaaaaataggggctgggcggggtggctcacgcttgtaatcccagcgctttggaaggccaaggcaggcagatcacaagttcaggagtccgagaccagcctgtgcaacatggtgaaaccccttctctactaagaataatttaaaaaaaaatagccaggcgtggtggcgcatgcctgtaatcccagctactcaggagactgaggcaggagaatcacttgaacccagggggcggaggttgcagtgagccgaggtcacaccactgcactccagcctgggcaacaagagtgaaactctgtctcaaaacaacaacaacaaaaagacactctacattttcttatatttatttagttccttacttagttattttgagacagtctggctctgtcacccagtggaatgcagtggcacaatcatggctcactgtaacctcaaactcctggactcaagcaattctctcacctcagcttcccaagtagttgggactacaggcacttgccatcacacctggctacttcataaagtttttttgtttgttttttgaggcagagtcttgttctgttgctcaagctggagtgtactggcatgatcttggctcactgcaaactctggatcctgggttcaagtgattctcctgctttagcctcccgagtagctgggattacaggtgtgcgccaccatgcccagctgattttttttgtattcttttagtagagatggggtttcaccatgttggccaggctggtctcgaacccctgaccacctgccttagcctcccaaagtgctggaattacaggcatgaaacactgtgcccagcccaacaatatattttatacaatggaataaatataaggtccttattattttgttttatgttactgctgcatagtattccttgtgtggacatattataatttgcttaatcagtcccctattgatggccatgtgggtgacttccaattttctgcctataagctcagcactttgggaagccaaggctagaggatcacttgagcccaggaattcaagaccagcctgtgcaacatggtgagaccctgtctctacaaaaaaatttaaaaggccaggtgtggtggctcatgcctataatcccagcactttgggaggctgaggcagacagatcactagagcccagcagttcaagaccagcctgggcaacatggtgaaactctctgtctacaaaaataatacaaaacttagccggatgaggtggctcacacctgtagtcccagctacttgggaggcttagatgggaggatctcttgaacccaggagatggaggttgcagtgagccaatatcacaccacagcactccagtctgagcaacaaagcaaggctccatctcaaaaaatacatcaataaataaaatttttaaataataaaaataatttaaaaattaaagttagccaggcataatggcatgcatctgtagttccagccacttgggaggctgaggtgggaggatcacttggtcaggaaaggtcgaggctgcagtgagttatgatcgtgccactgcactccagccagggctaaaaagccagactttgtctcttaaataaatatataaaataaaaagagaagttttggaaattatcgtgatgatcttgtgtgggaaatattctgaacacacaaaaaggacaagacattaaagaaaatattataaattcaagtacataaaatatttatattttattcatggatatacatatacacatgggtagtctcagaagcgttagggaattgagacagaatggaagctaaagaagagtaacaggtcaggtgtggtggctcacacctgtaattccagcatgttggggggccaaggccagcgaatcaggaggtcaggagatctagaccatcctgggctaacgcagtgaaaccccatctctactaaaaatacaaaaaattaggccgggcgcagtggctcacgcctgtaatcccagcactttgggaggccgaggcaggcagatcatgaggtcaagagatctagaccatcctggccgatatggtgaaaccctgtgcctatacaaaaattagctgtgcattgtggcgcttgcctgtagtcccagctactcaggaggctgagacagaagggaggcggaggttgcagtgagccaagattacgccactgcactccagcctggtgaaagagcgagactccgtttaaaaaaaaaaaaaaatttagccaggcgtggtggcacgtgcctgtattcccagctaccggggaggctgaggcaggacgccagtgcactccagcctgggcaacagagcaagactctgtctcaaagaaaaaaagaaaaaagaagaagaataacaaagaggagccattcatttactttgttttcaatgtttatatgtttataaacaatgttgcaataaataatttccctactgatagtcaatcacaacttttccattgttataaaccatgcttcaataaacatccttttatattcaaaaaacaagacaaaaaccaaaaagaaaggaaaaagtggggctgtgtctggcttagtgggaattgggtgccaagaaacaaaagcatgattgagtgttatctgtgtaattatgtgcatttgaggttaaaaaaaaggaggacagtagaaatgttgataattgctgggcgcgatgtaatcccagcactttgggaggccaaggcgggtggatcaccagaggtccggagtttgagaccagcttggccaacatggagaagccctgtctctagtaaaaatataaaattagctgggcatggtggcgcatacctataatcccagctatttgggattctcttgggattaaggagaatcgctcaaactcgggagttggaggttgcggtgagctgagatcacgccactgcactccagcctaggcaacaagagcaaaactctatctccaaaaaaaaaaaaaaagaaggaaaagaaatgttgataattaatgctctgccacccggacctctgcgaatcccttcttgtctgcttactgactcaccaagaccctaaggctctctctcccttcactgtcaccctacacttacagatttgaaatcttgcttccttcatttcaccctccccagcctagtgcatacttcccttgggcctaaaaaggtatctgaagtccaatctgaattccaaattccacactctaaatagcaccactaaagaaagtcactggaggaacaattatggaaaaacaggcactgacaggtactctcacgccttgttccattttccctgctttccttgactatgtcattgtcctatcccctcgccccaacccacgactacttcacaagcaccaaactcttttcagcctttattctttttttttttttttttttttttggggacagagtcttgccctgtcgctcaggctggagtgcaatggcgacatctcagctcactgcaacctccgcctcccgggttcaagcagaggctcctgccttagcctcccgagtagctgggattacaggcgcgcaccaccaccaccacacccggctaattttttgtaactttagtagagatgcggtttcaccatgttggccaagctggtctggaactcctgtccttgtgatccacctgccttcgcctcccaaagtgctgggattagagccatgagccactgcgtccagccttcaccctttattattttcagagttatttatcctacaagctacatcattgcccctcctcctcttccctatctcctttcattttcaggggagcctatttattagaggaagtaaactgaaggcagaaatcttcaaatacctggctaaaataaaaattattttttttagccgggtgcggtggctcacacctgtaatcccagcactttgggatgctgaggcaggcagatcacctgaggtcaggagtccagactagcctggccaacatggtgaaaccccacctctactaaaaatacaaaaattagccaggtgtggtagtgcatgcttgtaatcccagttactccggaggctgaggcaggagaatcgcatgagcccaggagacggaggttgcagtgagccaagactgcaccattgcactccagcctgggcaacagagtaagaatccgtctcaaaaataaataaattaattaattaaaaaaaataaaattgtatttaaaaaactccaaaacccttctttttttttttttttttttttttttttttttttttttttttgggatggagtctctcactctgtcgccaggctggagtgcagtggcatgatctcagctcactgcaacctccacctcctgggttcaagcgtttctcctgcctcagcctcccgagagtagctgagactacagtcacacaccaccacgcccagctaatttttgtatttttagtagagacggggtttcaccatgttggccaggatggtcttgatctcttgacattgtgatccgcccgcctcggcctcccaaagtgctgggattacaggcgtgagccaccatgcccagccaacatttcttaaaaaaaataaaagccacaatctgggtgcagtggctcatgcctgtaattccagcactttgggaggccgaggcagttggatcacctgaggtcaggagttcaagaccagcctgaccagcgtagaaaaaccctatctctactaaaaatacaaaaccagcctggcatggtggcacatgcctgtaatcccagctactctggaggctgaggcaggggaatcgccttgggaggtggaagttgtggtgagccaaggtcataccattgcactccagcctgggcaacaagagagaaactatgtctcaaaaaaataaaataaaataaaataaaataattaaaaaattagccaggtgttgtagcgggtgcctataatcccagctactttggaggctgaggcaggagaatcacttgaaccagggacgcgcagtttgcagtgagctgaggtcatgccgttgcactccagtttgggcaaaaagagcaaaatttaatctcaaaaaaaaatatcctttcatcatgtcctttcacagattagctcttatctgccctttttttttttttttttttttttttgagacagagtctcactctgtcgcccaggctggggtgcagtgacatgatctccgctcactgcctcagttcctgcctcagcctcctgagtacctgggattacaggcatgcaccaccacaccaggctaatatttgtacttttagtagacacacggtttcaccatgttagccaggctggtctcaaactcctgacatcatgattcgtctacctcagtctcccaaaatgctgggattacaggcgtgagccactatgcctggccacgcccagctaatttttgtattttagtagatatatggtttcaccatgttggcccagctggtctcaagctcctgacctcaatgatccacccaccttggcctcccaaagtgctgggattacaggtgtcagccaccctgccagcctcttatctgccattctaatggaatctgctcaactctctaccccacccatgcaactcactttcatacagaattcctgtatgcatgaaaacatgcccagccaggcacggtggctcattgctgtaattccagctctttgttaggctgaggccgacagatggcttgaaaccagcctggccaacatggtgaaaccctgactctactaaaaatatgaaaattagccaggtgtggtggtgcatacctgtaatcccagctactcaagaggctgaggcatgagaattgcttgaaccctggaggcagaggttgtggcaagccgagatgtcaccactgtactccagcctgggtgacagagtgagacaatgtcttaaaaaaataaaaaaattagggctgggtgcagtggctcatgctttaaatcccagtgctttgggaggctgaggccggcagatcatgaggtcaggagtttgagactagtctggccaacatgatgaaacgccatctctactaaaaatacaaaaaaaattagctgggcatggtggcaggcacctgcaatcccagttactcaggacgctgaggaaaaagaattgcttgaacctgggaggcagaggttgctgtgagctgatacctcgccactgcactccagcctgggcaacagagtgagactctgtctcaagaataaaataaaataaaataaaataaaataaaataaaataaaataaataaataaaaaaacaaaatgcttggctggatgtggtggttcacacctgtaatcccagcactttgggaggccaaggcaggagaattgcttgagcccaggagtctgagatcagtctgggccacatagcgagaccccgtctctatgttaaaaaaaaaaaataggaaaaaagaaaaaaaagcatgcccctgtctatattttattttcaccgagtaatgtgctctatttctggaaatactttcatccttccttcctctggctctccactgatgcatctccaaagcaactccaatcaattcaacaaatagttgttaaacaaccagcacattctaggcaggatgctaggagctggggggatcgagataaacaagaagcagtcctgttcccagagaagttcacaatctgatggtaaaagcaaatacaattatgtaagaaaataaatcaaattaggccaggtgtaatggctcacgcctgtaatcccagcgctttgggaggctgaggtgggcagatcatgaggtcaggagatcgagatcatcctggctaaaatacaaaatactaaaaatacaaaaattagcccggcatagtggtggacacctgtaatcccagttacttgggaggctgcgcaggaggataacgaggtcaggagatcaagaccatcttggctacgtaggagaatcgatagaacctggaaggcagaggttgcagtgaactgagattgctccactgcactccagcctgggtgagaagaacaaaactccatctcaaaaaaaaaaagaaaaaaaaatttcggctgggcgcagtggctcatgtctgtaattccagcactttgggaggctgaggcaggaggatcatgaggtcaggagatcgagaccatcttggctaacatggtgaaaccccgtctctactaaaaatacaaaaattagctgggcatggtggtgggcgcctgtactcccagctacttgggaggctgaggcaggagaatggcgtgaacctgggaggcggagcttgcagtgagccaagatcaccccactgcactccagcctgggcgacagagtgagactctgtctctaaaaaaaacaagttttgtttaatgaaaaaagtaaggtgaacaacaacatgaataaatgttccttttgtgttaaaggatcaatataagaactgtatcaaagtttgcttatatatatgtaaagaaatactgatggtgtgcacctgtagtcccagctacttgggaggctgaggtgggaggactgcttgagcccaggagtttgaagctgcagtaagctgtgatcgtggcgctgcactccagcctgggcaacagagcaagatcctgacacaaacgattcattaaaaaagtaagtgtcatgtttaccaattggaactggaccaatgagggacaagaatttcagggagactttgtattgtacaacgtttatgtaatttccagtatttgaaccatgtgacaacattaactgtttaaaattaaattacaagaagtttggagactgaagtggattacctggatattccaagactgtttgtttaatttacctctttataacctccattctcttagtccctgaggcgaaaatcctccccgtttccctttatctctaggctcgtaagaattttaacccacaagaaatatttattaggtatgtttaaattacaggtaacagtgactggagtgcaatggtgtgatcccagctcactgcaacttctgccttctgggttcaagcgattctgccgcctcagcctcccgagtcgctgggattacaggatgcgccacgacgcctggcaaatttttgtattttagtagagatggggtttcaccgtgttggccaggctggtctccaactcctgccctcaggtgatgtgccggccttggccgcccaaagtgctgagattacaggagtgagccaccaagcctggccccccctccttttttttttttttttgagacagagtctggctctgtcgcccaggctagagtgcagtggcatgatgatcttggttcactgcaacctctgcctcccgggttcaagcaattctcctgcctcagcctccccagtagctgggattacaggcatgtaccaccacgcccagctaatttttgtattttagtagagatggggtttcaccattttggccaggctggtctcgaactcctgacttcaagtgattcgcctgccttggcctctcagagtgttaggattacaggcgtgagcttctgtgcctggccttatcagcctttttagtgactaggacaagaatacaaaatgctttcctttccttccgactgctccctccctccttgtaatcatgcaaaatgcaggaagtaatttggaattcctagttaattctcctccccctcacttggagagcagtgaaggcctggggagttcgggaactttccgtggagcccagactggagagacgtccggccagggccaagacaacctgcttcccttgggcctctggtgccttgttgaggtcttggacctttcagatgctactgtgactgtggtttccggcttcctgagttctcacactcagcttggtgctgcagagatcacaccccagttcctgcttttggggactgacatgctcaagtttggtgatactcagtacatggggtctgtgagatctagagggcttacttttctgttttagtttccctcttttcccttaacagactcactgtaagtgctttagggttgcataaggatagagtatagaggtttgctgggtagacattgagaaagatcagtttcctaattgaatattttatctcatgttggatctttaattctgcttctctttagctaggaatattttgaatatgctgaatctagtaaaaaagaaattagaaatgaagttgtatagaactttgtagttcagtacattttctcacatattattgaacttaaacgtgacaattctgcgttggtagatatatattatcccattgagtaaaaaaagtgaatattgaagaaaagcaatgcctacagagagtgacaactcttccatgcaggtagatgctttttgtgctatcctatactttgtatggatgcacacagggtttcattgtggagctctcagcttatgggctgggactacagttttgaaatacagtattagtaagatgctggggaggatcttaaggcagaaggtagatgttacttctggtctaaagtcagtggactttagaccaaaatcttgtaaactggagctctctggctagcattccattaatattcagttcagaagaagctggtaagtcaaatttctgcaagtttttacatcagaaagagcttagctcacaaggtacttttttctcatctgtattcagttatttttccctgatcagtgtcagtctccttccaaccctcacttcccatcttggggagtacccttaggggcaggtcattcctctcttctttccctggcaggctggactcatccatgtgacctgagattggccaatcgacagtggctgctggccaagaccttgcctcttgagtgagtgactcaaagacaaagggatactaagattgaatcacagcagtggtgcgcagtgttgctgggggcagcagctgttgttgctctttcttggtggagctgtccttgtgcctgtttgttttccaagcctgcactcctgttgtagctcaggggcccttgtaacatatttctcttttgcttgccatgattacttcaccagtctgtgagctcctcgagagcagggcctaagtctcattgtgctctgagtgtttggtgcccatcttgaatttgactctcggtaaatgcaggttgaataagtaaagaaacatgctatatttatacggggctacagagtctggagttcttggcattattgtggttggggggcaaaaagttctttgtgtgctaccatagccactgacatctgagcaatttcatattaataaacataaacccagaggatcttgggaaggcccttcctatatgtgagcacttacttgactgagtggcactgattctcaaattgctgattttttaaaaagtatgaaatgtatcatgaatttgcatgcttatccttatgcaggggtcatgtgaatcttttctgtattgttacaattttattttattttattattattttttgagatggaatcttgctctatcacccaggctagagtgcagtggtgctatctcggctcactgcaacctctgcctccagggttcaagtcattctcctgcctcagcctctcaagtagctgggactacaggcatgcaccaccacacctggctaatttttgcatttttagtagagagagggtttcaccatgttggccaggctggtctcgaactcctcacctcaggtaatctgcccgtcttggcctcccaaagtgctgggattacatgcgtgagccaccgcgcccagccatgttacaattttaatagaatacatgtactgcccaagcaagtgtagctgaagcttttgtccctggttccacagtgtctctacctaagggctgctctttgccctgactacctcaactgaggcaataccctccttagtttccagccctggtttaaaaagcacccctcaggctggatttgctggctgaggcctgtaattccagcatttctggaggctgaggcaggaggatcacttgagccaaggagtttgagaccagcctggtcaacaaagtgagaccctgtctctaaaaaaaaaaaaaaaaaaactcggccgggcacggtggctcacgcttgtaatcgcagtattttaggaggccgaggcgcgcggatcatgaggtcaggagttcaagaccagcctggccaagatggtgaaaacccgtctctactaaaaaaaatataaaaaattagctgggcgtggcggcgtgcgcctgtaatcccagctacttgggaggctgaggcaaagaattgcttgaacccgggaggcagaggttgcagtgagccaagatcgcaccactgcactcccgtctgggctacagagcgagactctatctcaaaaaaaaaaaaaaaaagtggccaagtacggtgttaattccagcactctgggaggctgaggtgggtggactgcttgagcccaggaattcaagaccagcctgggcaacatcgtgaaactgcgtctctacaaaaaaatgcaaaaattagccaggtgcacacctgtggttccagctatctgggagactgaggtgggagaattgcttgggcctaggaggtggaggttatgaggagccgagactgcgccactgcactccagcctgggtgacacagtgagaccgtgtctcaaaaaaaaaaaaaaattagctaggcatggtggcatgggcctgcagtcccagctactcagaaggttgagctgggaccacaggtgcgcacgttcacgcctggctaattgttgtatttcttggagagacgggggtctagctatgttgcccaggctggtctcgaactcctgagctcaagtgatctacccacctcagcctctcatagtgttgggattacaggcgtgagccactgctcctggtctcatattcttttggggtggcttcaactccgaccttcgtccccagagaaaatacagctccttatccttagcagcaattggaaacctttctaggagttaatgataaagtgggggagaaatgagtgcaaaggctctgagatgagaagaacctggattgttagcggagttgaaggacactgagaatgtgggggagctggattcgtgaggataagaaagcagcaggtcaggtccagactttgaagagcctggtagatagtctaggtgaagagttagatcttaatccggagtagggagggaaacgagctttgagcaggggatggcgttttgaaaagacctctctgccggtgtacgaagaatggattagaacggcgaagagtaatagggtggaaaccatcttcatcttggagagagatggtggtcgcttcgatggagaaatgggaagctttgagacgcatttaggtggcaaaattaacgggtgatggatagcgtccattccccggcttcggtgatctcagtgattacgagtgagtggggacttcgtgttcctgctagggcgcgggcctgtttcccgcgcgtcagggtagtgggcgtggcctgcgcaggccgttgccacagtgatcgggcagacggggcagggggcggggcagctgggaccttacgtcactcggtggtggcgatgatgcgtgtgtgtggggggcggggcatacgctgggcgcgtcccgggggtcacgtggtgcagagcacgcagagtccttctgtcggttggtcctggagcggcgcagccggagtggggccgtgaggtgagctcgcggccaggcgaagccggccggccgggccgggttgggccgggcccgcgctgcgcgcgcgccgtgcgggcggggacggcgacggacgccaccgctgcttcggtcccctgcccggccccgctccccgcctggccccgctcgcccagcctggagggaggccctgggactgctgctgagagcgtggcgggcgtgcgagcggtgcccaatccccggggctacccgcaagagtggcggcggctgccgccaatcagcgccgcccgagggggctgggccgtggggtgcgggcccggggcgcggagcgggccgtgttgggggtgcgggtaagccctagggcccgagcctgagctgtgtgggcacctagagcctcatcagcagcctctgctattgccttgcgctttgggaatatgttttttaaaattggctttttttatcctattctggggagcacattcctttctcaagaccccaaatatgggagtgtcccttttctctatagttttgaaaactgggcggcacaccccctttcttaagctctagctctggaattttatctaaatttctaaaagccctcccccccccaaatttagggcgtaccctcttccgtcagcccccaaagtgggagcacattccttttttcgggcctccaatttgattctgcatttccgttccaatttagaggttcaccctgttatcgggtcctcagatctggggtccattagctaaagttttgggatactttcttgtatcccctctactccaaggaagaattccccttttccaggtcccaaatctgacagcatgccttctggaatttcttacatttaggggccacttcctttcctcagcccttcaaacctgaggttgggccgaaaacaatgtccaaattttgaagtttatgggtacttatttccagtttcacaaataagggaattcactgccttctcccgagactgtattattggggttacacacttttcacgtgttccccaaatcaaactaccttatttcctgaaggagactcattttcatatctgggagtatatttgtttcttgtgccccccaaatgtacgaggtgaaccccttttagttatacaactctcagagtgcagccactttccagatgcttcttaaatttggggggcacacctttttgtgagtcctctcatttccaggtggcgagtggtctgtggttttgagcatgccttcctaccctgtttagcttttctgtcatccaagacattttcattcctcagtttccttccctttttggagccacactccccttgaggtgctttccccagtctggtcagtgcacccatttcctcttcctctggcgagtgcgtatctttgttcagcacggcacttttctctgtgcttctgcgggcttttcttctgagcacacttcccagagtcacacctcctgaattctcctctcctcccagggaaggattcctctcctaaagggctaccagcacattgtttttgataggcctatcttttatctttccgctagcaggatctcttctctcttggcttgcccaatccccaaacatttttctggtttctgtctttctttggaattgttctgtttacctagtggctataaagattttccttgtgctggaggtggcctcaagtctaggactgcctgggcccccagcgctggattcaaagtggaaaccatttctttggttaatcacaggactctgaatcctcctggtggtttacttctagaagacctaagattctgtttaggtgcatactgttttctcctttgctttatctccttgtgctggaaaacaaaaacaaacaaaactctcagatttttccagcactgcttctagcccataaacttcttccctatattggctttcttactatcttttatgaagaaaagatgtcgtttggaggaatcccttggatactctttttgttcttgtccctggggtgtcggtggggaaatggatatttttctctcccaatcatcctcttgtcaatcttctttttttttttttgagacagagtctcgctctgtcgcccaggctggagtgcagtggcgcgatctcggctcagtgcaagctccgcctcccgggttcacgacattctcctgcctcagcctcccgagcagctgggactacaggcacccaccacaccgcgcccgtctaatttttttgtttttagtagagacggggtttcactgtggtctcgatctcctgacctcgtgatccacccgcctccgcctcccaaagtgctgggattacaggcgtgagccaccaagcccggccaacctcttgtcaatctttacccccaatcctcacattaaaatctgcaaatatctgggacctcctatctcttaagagcctcaatagttctttcttttgtgtttccttctgcctttacagatcttattcagggcttctcagcctgaacccccaaccagattaatttctccacagctggaattccaagtgcttggggataatgatacctctgacctttcttccttttgggaagtacttgagtgtgcagctgcatgaggcctcagcaggagagagattttaggtccaagaagctataccagtaggacaaggcaggaaaatactacactttcaggatcaagcccctctgactctcatttggaaactggatgtttgctaagcacctgcttcttaaggatgccgagggatttaatgatactcccagaaacctggagagattaatggggcctatggagaagtgctctgaactcagtgttgggacttgaataaaattaaccattgtcatgttttcagaacaactaagctgttttatatttcatgtgcatgaaagccctagaactaagttgtgttatttccagaaatgaaatagatcccacagttagatgatgtggccattaggaagtaccaaatttataaaaatcactggaggtctgtctgagcagtacctaataaaatatagtatactgaaagtgaacagatactttgtctctttctttggctgcttgatactttatctgtgtactgccgtacagtgcacccttaaagtattctacaccagtgcttctcaaacttgaatgtgcatgtaagtcacccaggggtcttgttgaaatgctgattctgatttggtagatctaggatgggacctgaatgcatttctgatttgcaggtgatgctgatgttactgaactacacttttagtagtgaggtttcatacacgaagacaaagtttctctgtgaaaataggaaggtggtggttagccttatatttttttattttatctttatccagacacacatcccttaaaagtttgtacaaggccatagtcccctttattagttatactcaattagttattctagcacatagctttttaaatattggccaaaactggctgggcacggtggctcatgcttgtaatcccagcactttgggagctgaggcgggcagatcacgaggtcaggagttcgagaccagtctggctaacacagtgaaaccctgtctctactaaaaatagaaaaattacctgggtgtggtggcaggcacctgtaatcccagctacatgggaggctgaggcagaatacttgcttgaacccgggaggcggaggttgcagtgagccaaaattgcaccactgcactccagcctgggccacagagtgagactctgtctccaaaaaaaaaaaaaaaaaaaaggccaaaacttctccaggagtttggtttctgtgtgtatatatatatattttgggtggggacagggtctcattctgtcacccaagctggagtgcagtggtgtgatcacggcttactgcagcctcaaccttctgggctcaagcgatcctcccctcagcctcttgagtttcagggaccactggcacgtgccaccacacctggctaattttaaattttttgtagagatgagatcttgccattttgcccaggttggtcttgaacttctgggctcaagcagtcctccaccttagcttcccaaagtgttgggattataggtgtgagctgccatgcctggctattgccaaatttaaatggttacatatttcttacttgaatgtgaacataattattgatatagaatcattctaataaatactgcatagccagcttgtctgtctggttcctcatcctaccatgagtagggagtctgtgataccccaaatcagtgggtcacaggtgttggaatttccaaagagtccttcttggttttctgggttctggaaatgggccaggaaaagccaggataaagctatgttccccgacctcgaatggaagcttctggctttctctaaatgggtgctccagaaagacaaatgctggggagaagatgatattctttgatggtgatcatgctttatgatgatctttctccttttgtacccacatgtctaatctattctaagtctcaagtgggtttttccttttttcaaaaaatttttttggagacaaagactacctctgaaagtgtttttcctttctaagtgtgttggatcatctgtacctatttccctggctgtcacctgtctggccctcttccacgtgatcctgttgccagccctaatcaggacaaacctgaatgactagactattttgtgtccctgtcctcctccaacccctattcctcacatgagtgtcagatcctattcagtaacggatttgatctggatttggctctagtcctagctcttccatttactgtgagacctcaggcaagtcacttaatgctatgggcctgcttctccccatttgtaaaatgaggggctgatgatctgcaatgtccaccctggctgaatcttggtcgctaccttgcttagaaaccccattgcctgtggtagcttgttgcagcagatctgatttctttcatgtgctcccttgggcagcctgccagttattcccttgtccaagtcacttctgccattatctttttttctagctgaggcagccagcttgttctcaacccaacttcagcgttcttcttgcttccatgtcttcttccagttccatgctgtatttcattcagaactacctgaaatcctcaaagaagtcttcctgagttctccattcaatgtttgtgacttctctgccttaccaagaaggagtctgtaccttatataccccgtatttacttgtcagttctcttatctaatgtatacttaaaaagggacttcatttcctccataccacagctttgttttttggtttgaattagcagggcaggtggcatgaaatttaaagaggaagcaagcaggttgtttgcctttggctgggatttggggaaagtatgagatgtaatgtttttagtccccttccccaagatctcctgtatctgtgggaatcagttgcctggtatgtcttcctggattgtaaaggtgcttaaacttcctttctgaagtttgaaagtgtatcctaagtgcaaataccatttgacaattactcgtggttgggtgggtgcagtggcttacgcctgtaatcccaacactttgggaggccagagtgggaggattgcttgaagccaggagttcaagaccagcctgggcaacaaagtgagattcctgtctctactcccccaccaaaaacaaaaaagtagtcaggcatggtggtgcgtgcttgtagtcccagctccttgggaggctgacgagggagttcagagtctgcagtgagctaggattgtaccactgcactacagctgggtgacagcacgagaccccattgcttccaagtgctcttctaggaacacacagccacaaaacccagaacaaggaattgttaaggataatgataagaaatctgtatttcaaataacttaacaaatgaataaaaccaacagttctttgagagcacctgattattgtcaaagacagttgctgagggggcttggaagtcaggacttaaaggtatatttaacctctggagttttcttctttcatcatcttcctaagaaataatagggaggatgtttacatttttcttgataaagtctttttattaattttatttatttatttattttgagaaagggtcttgctctgttgcctaggctggagtgtagtggcgcagtcttggcttactgcaacctgtgcatcctgaattcaagcgattcttgtgcctcagcctcctgagtagctgggattataggtgcgcaccaccatgcccaactaattttttgtagttttagtagagacaaggtttcactatgttggttaagctgggacatttttcttgataaacattctttaaaccaaaatgtatgcttagtcaagatccttgattggattatgagcctagagaaaaggagggtgatgtctttgtctaatccatctttgccagtgactgccccttacaggctattgactatagggtaacctaatgaaaattgagacaggcactgtggctcacgcctgtaatcccagcactttgggaggccaagtcggatggatcacctgaagtcaggagttcaagaccagcctggctaacacacagtgaaactccgtctctactaaaaatacaaaaaattagtcaggcgtggtggcaggtgcctgtcatcccagctactagggaggctgaggcaggagaatggcttgaacccgagaggcagaggttgcagtgagccgagattacaccactgcgcttcagcctgggcaacaagagtgaaactgtgtctcaaaaaaaaaaaaaaaaaattgaacccttaatttgtaataatgctttgacaactttgctagatcttgggctaggtcctacctggaccttcctctcttttgccaaataatggaactaatgagctggcagaaatcctgtacaattttagaagcctaatatgagtgactaaatgtaaataggacagttttaggaaagagtggtggagcctgaatcagtgaactttggggaaggagcaagaggaggggcttgggatttaaacaaagggtttttttttgttttgttttgttttttgttttttttttgaggtggagtctcacttcgttgcccaggctagagtacaatggtgcaatctcggctcactgcaacctctgcctcccggattcaagtgattctcctgcttcagcctcccaagtagctggtactacaggtgtgtgccacctcaccctgctaatcttttatatttttggtagagactggctttcatcatattggccaggctggtctcgaactcctgacctcatgatccgcctgccagggcctcccaaagtgctaggtttacaggtgtgagccactgcgcctggcctaaaccaaggtttttattcagtgatagtttattccatgtcaggaacataattctcagattttaaaggctgacttccaggtatcttagaaggatatttgggggtctctgtcctagtagagacctgattttcaagaggtctctttctcatatggaaaaagtccatagctggtggattgacattcctttctttctttttttttttttgttgaggcggagtctcactctgtcgcccagaagtgcagtggtgcaacctcggcacactgcaacctctgtctcctgggttcaagcaattctcctgcctcagcctcctgagtagctgggattacaggtgcccgccaccatgcctgggtaattttttgtatttttagtagagatggagtttcaccatgttcgccaggctagtcttgaactcctgacctcaagtgatccacccgcctcggcctcccaaactgctgggattacaggcgtgagccactgtgcccggccaatgcctttcttgcttctacaggtgcacaggtgttgggatttcgaggttgtggaaacttggtctggaaatgtgggcattttacaataatgataactatagctagcatttttggagcactgtcttaaatgtcattgaatccttacatctgacctattatcctgtcctaacagaggaggaaactgagatgagtaatttgtccaaggtcatttggctaataagcagggcctcgattggagtccaggtttctttgcctcctgtcccagtgctcttacatccctctctctctagctaacgtgctttttcccctagaaatttgagtaagtcattttaactacaaatcaaacaggtggcagcctggaaaccagcactgaggcactttgccaccctcaccccagatttcttttttttttttttttttttttgggacggagtctcacattgttgcccaggctggagtgcagtggcacaatctcagctcactgcaagctccgcctcccgggtttacgccattctcctgcctcagcctcctgagtagctgggactacagatgccctccacgatgcccggctaattttttgtatttttagtagagacaggggtttcgccatgttagccaggatggtctcgatctgctgacctcataatccatccgcctcggcctcccaaagtgctaggattacaggcatgagccaccatgcctggctcattcttttttcttttttttcttttctttttttttttttgagacagagtctgactctgtctcccaggctggaaggcagtggcatgatcttggctcactgcagcctccgcctcccgggttcaagtgattctcctgcctcagcctcctgagtacctgggattacaggcgaacaccaccacacccggctaatcttttatatttttagtagagacggggtttcaccatgttgcccaggctggtcttgaactcctgatctcagatgatccaccagccttggcctcccaaagtgctgggattacagacatgagccactggtgcctggcccttttttttttttttttttttttgagatggagtttcaccttgtagcccaggctggagtgcaatggcacgatcttggctcactgcaacctccgcctcccgagttcaagtgattctcttacctcagcctcccaagtagctgggattacaggcatgtgccaacacgcctggctaattttctgttgttagtagagatggagttttaccatgttggtcagtctggtctcgaacccctgacctcaggtgctccacccacctcggcctaaagtgctgggattacaggcgtgagcaagattttattcttttttttttttctgagatggattcttgctctgtcacccaggctgaagtgcagtgacacgatcttggctcactgcaacctccttctctggggttcaagtgattctcatgcctcagcctcctgagtagctgggattataggcctgcaccaccacatccggctaattttcatatttttgatagagacgggtttcaccgtattagccaggttggtctccgcccgcctcagcctcccaaagtgctgggattacaggcgtgagccactgtgcctggccttcattcttgaccatgcaaaacatcctttaattgtagaagcccagttctcccaactcaagctgcctttctacatttttctttcttcttcaatttttgttgttgttgttgtcgtggtcagatacacataatataaaatttgccattttaaccatttttaagttatatagcttactggtattaaataatgttgtgcaaccatcaccactctccatctccgtaactcctcaaaattgaaactctgggccgggtccagtggctcatgcctgtaatcccagcacttcgggaggctgaggcaggtagatcacttgaggtcaggagttcgaggccagcctggccatcatggcaaaaccccatctctactaaaaatacaaaaattagctgggcgtggtagcacatgcctgtgatcccagccactagggagcctgaagcaggagaactgtttgaacgcgggggcgggtggaggttgcactgagccaggattgctgcactgcactccagcctaggtgacagagcgagactccatctcaaaaaaaaaaaaaattataactctgtacccattaaacactgactccctctttcatgaacctcctcccagccccagcagctaccattctactttctgtctccatgtttttgaatacttttctgccttttttgaggctcctgggcatgactggtttgggttgcttgactgtcccttggttccatggagtattgaattctgtgtaatgtgctttgatgagtaggaaattggtcgtgctgtgacctatatgataattagacatgtgcaacttgtaaaggcaaggtaattaaagaggccacttttctttttcttgttttgttttttttttctttttttcttttttttttcttctctttttgagacattctcactctgttctccaggctggaatgcagtgacatcatctcagagctgactgcaacctctgcctcctggattcaagcaattctcctgcctcagcctcccgagtagctaggattacaggcggatgccaccatgcccggctaatttttgtatttttggaagagatgggttttcaccatattcgccaagctagtcttgaactcctgacctcaagtgatccactctcctcggcctcccaaagtgctaggattacaggccactgtgcctggccaagaggtcacttttcatgtccaggctgcatggtatgtggtggtgaggatgtaggatttggaggtggaatgcctgagtttgagtgcctgtatttgccactctcttggggccaaatgtaatttgggcatatggcttaaacctcttgaacctttcattgtgttatgcacattggaggcagaactttccagcctagcaagttacttaacctatatgagcctgtttcctcacccaagtattatcataactgtctgacatcagtcattggaaatatcagtaaatgttaccctttccctccatttcctaatctgtaaaggaaattaaagaaacctggtttggctgggcacagtggctcatgcctgtaatcccagcactctgggaggccaaggcaggaggactgcttgaagccaggagtttgagaccagtcctggccacagagtgaaacctcatctctataacacagaaaaaaaaaaaattagtttggcatggtggtgcacgccttgtagtcccagctccttgggaagctgaggtggaaggattgcttgaacccaggagttcaaggctgcagtgagctatgatcctgccactgtactccagtgtgggtgacagtgagagcctgtgtttaaaaataaaaaaaagaaaagaaaaagaaaacatagtttatagagttttcctggcttgaagatttatgaggagttgagtatatgttaccattattacttttgttttattcctctcagaaaatgtgtgtaaaattcctccatgggcccttcagtgggccttgttagtttgtatttcatccataactttatcagtagtgtatgccaaagaaaaagactcttactttttttttttctttatgatggactctcactctgttgctcaggttggagtgcagtggcacaatcacagctgtcttgcagcttcaacctcctgggttcaagggatcctcctgcctcatcctcgtgagtagttgggactacaggtgtatgccaccgcgcttggctaattttttttttttttttattatttatagagacgaggtcttgctatgttgcctaggctgatctcaaactcttgggctcaagtgattctcctgcctcggccttccaaagtactgggattggccgggcatggtgcctcactcctgtaatcccagcattttgggaggccgaggtgggcggatcacctgaggtcaggagttcgagaccagcttgaccaacatggagaaaccccatctctactaaaaatacaaaaaattagccgggcatggtggcacatgcctgtaatctcagctactcttgggaggctgaggcaggagaatcgcttgaacccaggaggcggaggttgtggtgagccgagatcgtgccattgcactctagcctgggcaacaagagtgaaactccgtcttaaaacaaaaccaaaccaaagtactgggattataggcatgagccactgtcccgcccttacgtttgtttgtgtgttttttttttttttgagacagtgtatcgctctgtcccccaggctggagtgcagtggcacaatctcggttcactgcaacctccacctccagggttcaagcgattctcctgccttaacctcccgactagctgtgactacaggtgcctgccaccacgcccggctaatttttgtatttttagtagagatggggtttcaccatattagccaggctggtcttgaactcctgaccttgtgatctgcctgcctcggcctcccaaaatgctgggattacaggcgtgagccactgcacccggccacattttttttcccctcattttcacacacacaaaactaacagtaatcccttaatatttttaatgttgaaatatcccaaagactttttttttttttttttttttgagatggagtctcactgtgtctcccaggctggagtgtggtggcatgatctctgcttactgcaacctctgccttccgggctcaagagattctcctgcctcagcctgccaagtagctgggaatacaggcgtgtgccactatgcccagctaatttttatgttgttaacagagatggagtttcaccatgttggccaggctggtcttgaactcctgacctcaggtgatctgcccacctcagcatcccaaagtattgggattacaggcatgagccactgcactcagtcccttgtttttaaaagcaataaaggttagtgggggccgggtgcggtggctcacacctgtaattccagcactttgggaagcttaggtgggcagatcacttgagctgaggagttcgagactagcctcggcaatgtggcaaaaccccgcctctataaaaaatacaaaaatgaggaaggggtggtggcacgtgcctgtagtcccagcactgggggagctgaggtggggaggatggtttgagcctgggaggcaaaggttgcagtgagccaggatcatgccgcttcactccaacctgggccacagaaacagaccctgtcttaaaaaaaaaaaaagagggtagtgggttttggaggaaggaggtcttgcttctgaagtcccagctcttctatctagccaggtgactttgggcaagttgtttattgtttatactccttcgtaaaatactgctgacttctctgcattgttgggaatgagatgtttgtcaaggatttagcatgtggtgataaatcagtaaatgttgaatatttcctggtattaataataaaggctaggaataaaaattcatacttaaaggaaaatggacttttatttatttatttatttttgagacagagttttgctcttgtcacccaggctggagtgcagtggcacaatcttggctcactgcaacctctgcctcctgggttcaagcgattctcctgccttagcctcccgagtaggtggtgctacgggctcctaccaccatgccgggctaatttttatatttttagtagagatggggtttcaccacgttggccaggctggtctcgaactcctgacctcaggtgatcctcccgcctcagcctcccaatgtgctgggattactggtgtgagccaccacaccctgccaagataagggaattaatgaattgtctcataaatatcttaggtatttaaaactccataggcatgaaaatgtctctcaaggccctgttgagtaatgatttcatctccaaattgttttcctttgtaatatggtgatatttcaattaagaaattctgtaagaataggccgggtgtggtggctcacgcttgtaatcccagcactttgggaggctgagaccagcctggccaacacagtgaaatcccgtctctactaaaaatacaaaaaattagctgggcatggttgcaggtgcctgtcatctcagctacttgggaggctgaggcaggagaatcgcttgaacccgggaggcggaggttgcagtgagctgagattgcaccactgcaccccagcctgggcgacagagcgcaactccatctcaaaaaaaaaaaaaacaaaaaaaaaaacaaatcttgtaaggatagctggtcaggtgtgtttaaaaaaagacttcccagctgggcgtggtggctcacgcctgtaatcccagcactttgggaggccgaggcaggtggatcacgaggtcaggagatcgagaccatcctggtcaacatggtaaaaccccgtctctactaaaaatacaaaaaaaaattagttgggtgtggtggcgtgtgcctgtaatcgcagctactcaggaggctgaggcaggagaatcgcttgaactagagagttggaggttccagtgagccgagatcgcgccactgcattccagcctggtgacacagcgcgactccgtctcaataaataaataaataaataagacttcccctaggctgtgagcagtggctcatgcctgtcatcccagcagtttgggaggccgaggcgggtggatcacaaggccaggagatcgagactatgctggccaacatggtgaaaccctgtctctactaaaatacaaaaaattagcccagtttggtggtgcacgcctgtagtttcaactacttgggaggctgaggcaggagaatcacttgaaccaaggaggtggaggttgcagtgagccgagattgagccactgcactctagcttggcgacagagcttgactccgtctcaaaactcactccagagctatagactatatcactcagagagtgtagagtattgatagattggagcccccagtgcctgaagaaatggatacagcttttcttaagccccagggataaaactgtgatcagtcttcagttgcttcattccgcatgctttgccttcctctgcacgcaaggagtaataatagttcccacgtttacctgtggataacactcttcaaagaacctccatgtgattatcttcttgaatctatatacccattgaggtggatgatattgatctctttcctgttttttttttttttttttggagacagggtctcttgctctgttgcccaagctggagtacggtggtgcaatcatagttcactgcagccttgaacccctgggctcaagtgattctccagcctcagcctcctgagtagctaggacgacaggtgtgtgtcactgtgcctggctaattatttatttatttatttatttatttatttatttatttcagacagagtttcactcttgttgcccaggctgcagtgcaatgatgtgatctcggctcactgcaacctctgcctcccaggttcaagcgattctcctgcctcagcctcttgagtagctgggattacagggatgcaccaccatgcccagttaattttgtatttttagtctagacgaggtttcaccatgttggtcaggctggtctctaactcccgatctcaggtgatctgcccgcctccacctctcaaagtgctgggattacaggcgtgagccaccgcgcccagcctatttttttatttttatttttactttttgagacagagtttcgctctgtctccctggctggagtgcagtggcacaatctctgctcactgcaatctccgcctcctgggttcaagcgattctcctgcctcagcctcccaagtagctgggattacagggaagcaccaccatgccagttaattttgtatttttagtctagacgaggtttcaccatgttggtcaggctggtctcgctctgtgcccacctctgcctctcaaagtgctgggattacaggcatgagccaccgcgcccagcctatttttttatttttatttttactttttgagacagagtttcgctctgtctccctggctggaatgcagtggcgcaatctttgctcactgcaacctccgcctgggttcaagtgattctcctgcctcagcctccctggtagctgggattacaggcccttggcaccacacccggctaatttctgtgtttttagtagagtcagggtttcaccattttggccaggctggtcttgaactcctggccttaagtgatccacctgccttggcctcccaaagtgctgggattacaggtgtgagctacctagcgcagctctatatttttatttatttgtttatttatttattttttgagacggagtcttgctctgttgcccaggctggagtgcagtggcgcgatctcggctcactgcaagctccgcctcccaggttcatgccattctcctgcctcagcctcctgagtagctgggactacaggcgcccgccaccacgcccggctaattttttgtgtttttagtagagacagggtttcctcatgttagccaggatggtctcgatctcctaacctcgtgatccaccctcctcggcctcccaaagtgctgggattacaggtgtgagccactgtgcctggcctattttttttattttttgtagagttgagatctcactatgttgcccaggctggcttcaaactcctggcctcactcaagtgatcctctcaccttggccttccaaagtactgggattacaggtgtgagcaattgcacctggcctcttttctgtttttatttccattttgccagtgagaaggctgaggttacctctttttttttgagacgtagtctcgctctgttgcccaggctggagtgcaatggcatgatctctgctcactgcaacctccacctcccatgttcaagcgtttctcctgcctcagcctcctgagtagctgggattaccggtgtacaccaccacgcctggctaatttttgtatttttactagagatggggttttgccattttagccagggtgttcttgaactgacgtcaggcgatccacccaccttggcctcccaaagtgctgggattactggcgtgagccaccacgcctggccaggttatatcatttaacaaacatttgaccaccatgttaagggcactgcttgttagatgctggggatgcctatgaggagttaattgcctcttgggagagatctgcttagataggcagtttcagcatagagtgatgaatgctgtggcccagagggtaggttaggttgccatgggagaatgcaggtgtgaaggaagtccttcagggaggttccaatggctaatcctggtcatgaaggaccaggaagagaaagcagcttgtttggccaggtgcagtggcttatgcctttaaccccagcactttgggaggcttagtgagggagggggcagatcacctggtcaggagttcgagaccaccctggccaacatggtgaaactagagactagcccgtctctagtaaaaatacaaaaattagcctggcatggtggcttgctcctgtaattccagctacttgggaggctgaggcaggagagtcgcttgaatctgggagacagaggttgcagtgagccaagattgtgccattgcactccagcctgggtgacagtgcaagactccatcaaaaaaaaaaaaaaaacaaaagcagcttgtttatacaaaggccctggaggtcggaactgcagggtgtttggatgtggcaggagtatgggtggtaagaacagtaataacccttttttctttttctttttctttttttgtgacgcagtcttgctctgtcttccaggctggagtgcagtggcgggatctcggctcactgtaacctccacctgccgggttcaagcaattctcctgccttagcctcctgagtagctaggactacaggcgtgcaccaccatgcctggctaattttttatatttttagtggagacagggtttcaccatgtcggctaggctggtctcgaactcctgacctcatgatccgcctgcctgtgccccacaaagtggtgggattgcaggcgtgagccatggcgcccagcccccgcccccccccccccctttttttttatacacagttttactcttgttccccagtccggagtgcagtggctcgatctcagctcactgcaacctccgcctcccgggttcaggcaattctcctgcctcagcctcctgagtagctgggattacaggcgtctgccaccatccccagctgatttttttttgtgtttagtagagatgggttttcaccacattggccaggctggtcttgaatttctgatctcaggtgatccgcccgcctctgcctcctaaaatgctagaattacatgcatgagccaccatgcccagcaagaacagtagtaaccctgcaagcttattgtgtgccaggctctgctaaataacttttttttttttgacggagtctcgctctgtcatcccggctggagtgcaatggtgtgatcccggctcactgcaacctctgccttttgggttcaagcgattctccttcctcagcctcccctgtaggtgggattacaggcgcatgccaccacgcctggctaattcttgtgtttttagtagaggcgggatttcaccatgttgacaaggctggtctcaaactcctgacctcaggtgatccgcctgcctcagcctcccaaagtgctgggattacaggtgtgagccaccgggcctgacctgtgctaataacttttatcttcacaacacctatatgatggtttgaagtaggtgctggtgatatcctcattttacagatggggagcctgaagctcagagaggaaatgacttgtgcaagtttatctggaaagtggtggggctgaggtccaaactcaggcactcttattccagagttctggctcataaccgctgtgtcccacagcccctctgctaaagcttgcctgcttctctccttttaagctccaaaagagagtttcttttggcttggttataatggctaactcactaatggcccaaatgctgcgctgagtaccttgaatatggttctgtaggggagccgctgaactgttttttttgtttgtttgtttttgttttttgagacagagccttgctctgttgcccaggctggactgcagtggcgcgatcttggctcactgcaacctccacctcctgggttcgagcgattctcctgtctcagcctcctgagtagctggaattacaggcgtgtgccaccatgcccggctaatttttgtatttttagtagaggcgaggtttcaccatgttggccaggctggtcttgaactcctgaccttgtgatccacctgcctcagcctcccaaagtgttgggattacaggcgtgagccaccgcgtccggcctgaactgttttaaaatagaagtcttatgatcatacttacattttagaaatatcactgtagcagcagtgatgaagattggcaacagtgtaattaactggagtcagccttacctcggttcaattccttgtcccaatacctgactagccttggtatttgggaaacttactttgtgaacctcagttttcacatccataaaatgggaataatcctcattacaaacctaagaggtagacactaaatgggctgatatagtttttatatatatgtatatatataccagaatagtatctatctatctatctatctatctatctatctatctatctatctatctatctatctatcttagaatagtatatacatatatatcttagaatagtgtatatatatatatatatatatatatcttagaattgtgtgtatatatgtatcttagaatagtatttgtcataaaataaccactgagaagatgtcatctcatgagacagtattgatttggatctggggaaggtatagctggaggattggagctctgtcaagagctgctggagtaatcaagattagaactgatgcagggctgaactgggcatccacttggcaatggctgagacttagaagcaggtcctacaaaatgttgtccgagtgtgggaggtgagggaaggagaaggaggtaagggaagtgcccatgtttctagtttggcacacttgccaatcttgagggcttatttgatggggacaaaaggagaaggaacttgtaagggtaagatgattagctcagtgaaattgagtaatatgcgaaaggtcatacagcagatacattttagggccaaccctggcacaggccctttccactgcttctgggaaaatccactgatttaatcgactcattctcagtagtttggaatgagtaaactcaactcatgtttgctgtctctttgcattttaattatggaaggcaaagcttgactcttgcagaaagcatttcaagtatctgggaagaaagtgggtgaagttttgaggcctatttctttcttcactcttcttttttttacgacagagtcttgctctgtcgccaggctggagtgcagtggctcgatcttggctcattgcaacctccaccttctgggctcaagcaattctcctgcctcagcctcttgagtaactgggattacaggcacctgccaccacgcccggctaattttttgtatttttagtagagacggggtttcaccatgttggccaggctggtctcaaactactgaactctggtgatccgccctcctcgacctcccaaagtgttgggattacaggcgtgagccaccgtgcctggcttcttccctcttttcattcttgcctgcccttccttccttcctttctttttcttcctccttacctcttctgcctttcctccctccttccctaccttgtcaagtaaaagggactaattccctttcttctagtgtgacctgggaagaggtcctacttgaaccaatttgtcacttccctacgactaaagatacgctctttatgcactttagtatattggatactgtttgttaatttttaataatattgactataattctttgtgtctgatgtcctttttgctagtataccaccattgccatcaccagtaccatttagagtttgctatgctaagcacttgacatccattagctcacttattcttcacaacaaccctaggaaattggggctgttgatcccatcttatagctgggcaaacaggctcagtgatttttcttgtcgtcgctcagccaacaatgcctggagccagaattggttagaatctgagtctaaaacctgtctgtgcacccatccctaggcattccctggccttcctccacggcagaactttggcaaaaggtcctcttggaggcttcttcctgggagacccaggtatcactggaccggctaaaattgtttatgctttcttgggacagcagcatgggctgtgggaagtctcaaccttctaggttcaagctgtgtgtggggaaagctcctttctgccggagattctttgcctgtagtagttgcctttgcttagaagtcacttcctttagatctccttcttgtcacctagttctctgcttagacctcagttcctcagagagtcctttctttttctttttttttttttttgagacaagagtctcgctctgtcacccaggctggagtgcagtggcatgatcttggctcactgcaacctccacctcctgggttcaagcaattctcctgcctcagcctcccaagtaggtgggactacaggtgcccaccactaagcctggctaatttttgtatttttagtagagacggggtttcaccatattggccaggctggtctcgaactcctgacctcaggtgatccacctgcctcggcctcccaaagtgctgggattacaggcgtgagccattgtgcctgtcttgagagtcctttctaacagccgtatctaaaatagtcctttccatgtcgctggttcacattattttgttgtttttcccacaattacttatctctgtcagaaatgatctttatatgctcgcatggcgcagtggctcatgcctgtaatcgcagcactttgggaggctgaggttggtggatcactggaggtcaggagttcgagaccagcctggccaacatggcgaaacactgtctctactaaaaatacaaaaattagccaggcatggtggtgcacgcctgtaatcccagctactggggagggtgaggcaggagatgcttgaacctgggaggcggaggttgcagagagccgagattgcaccttgcacgctgggctgggcgacaagagcgggactctgtctcaaaaaaaaaaaaaaaaaaaaaaggccaggcgcggtggctcacacctgtaatccccagcactttgggaggctgaggtgggtggatcgcctgaggtcaggagttcgagaccagcctgaccaatatggagaaaccccttctctgctaaaaatacaaaaattagccaggcgtggtggcacatacctgtaatcctagctaccaggaggctgaagcaggagaatctcttgaacctgggagatggaggttgcagtgagccgagatcgtgccactgcactccagcctgggcaacaagagcaaaactctgtctcaaaaaaaaaaaaaaaagaaaaaagaaatgacccttatgtatgtgcttatcttgtttcttagctgccttccccactagagaacagggtccgggtgccttgtcctcccattgtctatttccagtacctggcacacagcaggctctcaatgaatatttcttgaatgaggggggcataaagatttaagctggtctttcacctgaagtgtccctcaatttaaagtggttgtattgagttaaaaggcactgtcaccctttaatggaggttgaatcccagccttgtggtgagcaccattagattatcccaaagcctgttctgtagtttctggtggttggcattttattccttgagagtcccagagacttttttcctcgaaagttccagagtttatttccctctactcctgtcccagagctgattcactgaaaggtcttgttccatacccatctatcacttttaattctttgttgtccctcttttccctgagcacaaagggattgctgagggcaagacttccagttaccatagcgacagtactcttttgcctctcccaaaataaaacccagagtctttgtcagtacattaactgtaaatgtgatatgaattcagaaaatatgggcgtggtggctcacacctgtaatctcagcactttgggaggctgaggtgggcaaatcacctgaggtcatgagtttgagaccagcctggccaacatggcaataccctgtctctactaaaaatacaaaaattagctgggtgtggtggtgtgctcctgtaatcccagctacttgggaggctgaggcaggagaatcgcttgaacccgggaggaggaggttgcagtgagctgagattgcaccattgcactgtagcctggggacagagcgagactctgtcttaaaaaaaaaaaaaaaaggaagaaaaatctgctatcatttattgagtacctacttgtttttttttgagacgaatctcactctgatgcctgggctagagtgcagtggtgccatcttggcttactgcaaccttcatcccctggttcaagcaattcttctgcctcaccctcctgagtagctgggattataggtgtgtgccatgatgcctggctaatttctgtatttttttagtagagacagggtttcaccacattggccaggctggtctcgaactcctgacctcaagtgatctgcccactttgccctcccaaagtgttgggattataggtgtgagccactgcgcccagctgactacctactttgtgttagatattttaataggggttttgcagacctttctcatttaattctcatagcacccacgataggggccattatccccatatcataagtgaagaaacagagctcaacaatgtagcttgtaaataaacttggggtaagaatctgaactcaggagctactggactgaggttcgattgctggctcagctccttactatgtgagtgtccttaactttctttttcctcatctttataatggggattaatatagtacttctgtgatttttgtaaggattaaattggttaatatatgtaagtttaattattataaattttttttttgagacagtctcactctgtcgcccaggctggagtgcagtcgtgtgatctcagctcactgcaacctccacctgcagggttgaagtgattgttctgcctcagcctcctgagtagctgggactacaggtgcgcaccaccatgcccagctaatttttgtattttttagtggagacggggtttcactatgtttacctgggtggtcttgatctcttgacctcatgatccgcccgccttggcctcccaaagtgctgggattgcaggcgtgagccaccgcacccagactatacattttttttttatgcgggttttgttagtttggataaggttattttacatctactctctgtaaagttagtttatatctttatcatagtagtagcttaatagcattctttatttaatttattacatatttgttgagtttataatgtagtcctactgtaatgaattttgattaaatattctcttgttttttaatggatgaactacatccagtttgcccagaatcttatgtaaagagctattggtttttctcattttcacaaatgatttatttttatcctggactgtattcttcagcttgaaatggctgagtccaagagtataagcagttccacaggttgttctttgcttctagattaaggtataaaaagatggccatggtcaggaccccaggaggtgttctagtgtacctgtttccccacagctggaccagtgttaggttttgtcttttctaaaaaattaggtatttctgcttgttatataatggtgtgataattttgacacaacatttgaaaagcatccagttgctttatcttcctgtattcaagttatgtttatatctaaagatatgaatataagcatagcaacgactttggtcagagaaagaggaaggacctttgagaagtactttgtctacttctgcgtacatcctgttacttttgataagagggatttctcctgcctcagaggaccttgaaattggctagcacctctgcatgtcagtttcctccctgtaacttaattttacttgtataccatggtaacattacattagtcctaattatataatctggcagttgtgaagatccagtaaatagtaaaatagtgtaagaattaaattcttgcatttaaaaaatttgcaggtttttttttggattttttgtagagatgacatttcaccaagttgcccaggctggtcttgaactcttagattcaagctacctgccccttggcctcccaaaatgctgggattacaggcatgggcctatactcagcctcccaaagtgctgggattataggcatgagccagtgtacctggccaaaaatttgcatatttaaataaccttaaaagaaaaaaatgggccgggcgtggtggctcatgcctgtaatcccagcactttgggaggccaaggtgggtgcatcatttgaggtcaggaattcaagaccagcctggccaacatggtgaaactctgtctctactaaaaatgcaaaaattagctgggcagtagtggcatatgcctgtaatcacagctactcaggagactgaggtgggagaattgcttgagcctaggaggcggaggttacagtgagctgagatcgtgccactgcactccagtctgggcgacagagtgagaccctgtctcaaaaaaaaaaaaaagaaaaaaatatgaagaaacataaagaagcaaccccaccaccagaataaaataaaattttatcatctagataattcctgctgacaattacttctttggtggttttttttgtttgtttttgttttttggcttttttttttttttgagatggaatcttgctctgtcacccagactggtttgcagtggcacgatgtcaactcactgcaacctccgcctcctgggttcaagtgattctcctgcctcagcctcctgagtagctgggattacaggttcccaccaccatgcccggctaatttttgtatttttagtagagacggggtttcaccatgttggctaggattgtctcgatctcttgaccttgtgatcctcccacctcgacctcccaaagtgctgggactacaggcatgagccactgcgcctagcctggaatgggttgtttaatagatagcttattgtccttcacatgtataatcctttacattatacacttgtgaaaaattttcattgtgaaaaactaaaatttaggaaagtatttaagaagaaaggaacaatcaccaataacctataacttatttttttcttcctgtctttacaaaagaatcagtggctgggtaccatggctcatgcctctaattccagcactttgggaggctgagtcaggaggatcacttgaacctgggagtttgagaccagcccagacaaacacatagcaagaccctgtctctaccagataacaaattagctgggtgtggtggcttgcacctgtagtcccaggtgcttgggaggctgagtaaggaggatcacatgagcccaggaagtcgaggctacagtgatccaggtttgagccactgtagaccagcctgagtgacagagtgagcaagaccttgtctccaaaaaaataaattcatatgagtttttttcttttcttttcttttcttttttttttgagacagaatttcactcttgttgcccaggctagaatgtaatggtgcgatcttggctcactggaacctccacctcctgggttcaagtgattctcctgcctcagcctcccaggtagctggaattacaggcatgtgccaccatgcctggctaattttgtatttttagtagagacggggtttctgcatgttggttaggctggtctcaaactcctgacctcaggtgatccggcagcctcggcctcccaaagttctgggattataggcatgagccaccatgcctggccttttttttttgtttttgttttttaaagagacaggttcttgctctgtcactcaggctggagtacagtggcacaatcataactcactgcagtctcaacctcctgggctcaagcgatcctcctgcctcagccttttcagtagctgggattataagcctgagccacctcatctggctgtgtatgagttttaatgtgagctccatgtggtacaattttgcatcctgcctttttatgtaatatattgcaagcaaattcttcataaaatgtgctgctattaaacattagacatgtactcacttctgtgatttttttccatactcatttattgcaaagaaagtgttctggtaggaggcaggcattgctctggcagtgctctggcattgcttgggcagtgtaggctgtcaagagccaaagtataaggctggatgcagtggctcgtgcttgtaatcctgtaatcccagcactttgggaggcccaggcgggaggattgcttgaacccaggagtttgagatcagcctaggaacatagatactctctctgcaaaaaaaaaaaaaaaaaaaaaaaaaaaagctgggtgtgctgacgcatgcctgtgattccagctactcgggaggctgaggcaggagtattgcttgagcccaggagtctgaggctgcagtgagctatgatagcgccactgcattccagcctggacaacagaatgagaccctgtctaaaaaaaattttaaaaagtccagagtttagtgggaggaaagagttaggctggggtaagtctgctgtaaggaagtggcctgttcaagtgcccttagagttcagagtggctacatgtccatcagaaccaccactagctcctccgatagcatttaggaccctgcagattagtagattaattacctcagtgatcacaagaagtgttctttttttttttctttttcaagatggagtcttgctctgtcacccaggctggagtgcagtggcgtgatctcggctcactgcaacctccgcctcccaggttcaagctattcttctgcctcagcctcccaagtagctgggattacaggcgcctgccgccgcgccccactaattttgtatttttagtagagatggggtttcaccatgttggccaggctggtctcaaactcctgaccttgtgatccgcctgcctcggcttcccaaagtgttgggattacaggcttgagtcaccgcacccggccggaagtgttcttttatgggggccacttttcttgtaaatggcctaatccagtacaccttttttttccatcaaaaggaaattggctttactgtttggttctgatcataaatataaattttattcattgcagcacgagtacacgagacaggattgagaaaggagagattcaaattgtgacttcagattcaaaggcaattaaaggaattaaacgtgaatatttttactgttttattgttctatgattaaaaaaaaatctgggtaaaacttataggaaaatacaaatgatcagaatggactcaagaagtaggaaatatagctgggcatggtggcaggtgcctgcaatcccagctacttgggaggctgaggcaggagaatcacttgaacccgagaagcagaggttgcagtaagccgagatcatgccattgcactccagcctgggcgacaagagcgagactcctcaaaaaacaaaccaacaaacaaaaaaagaagtaggaaatatacatagatcaaagaaagtataaacaattctgggcgcagtggttcacgcctgtaataccagcactttgggaggttgatgtgggcagatcacttgaggtcaggtgtttgataccagcctggccaacatggtgaaacccaatctctactcaaaatacaaaaattagctgggtgtggtggcatgcgcctgtagtcccagctactcaggaggcctaggctccagaattgcttgaacctgggaggtggaggatacggtgagctgagatggcaccactgcactcagcctgggtaaaagagtatgactctgtctcaaaaaataaataaataaacagacctcgtacagccttccaaaagtagcaccaagtattaatatctcaacttttgtttgcttcgtttttaattttttttgtttttaagagacgagcgtttgctatgtttctcaggctggtcttgaactcctgggctcaaagaaacaacttggctctgccttccaagtagctggggctataggcatacattactgtgcctggcatttgtttgcttcctttgtaactctttaaatttcattgcaattacagtttgcagttatttatcagtttgctggctaaatttttgtgtttccccggtagactgaagggttcttgagggcaggagctgtgtctcttttggtcttgattgtttccttaaatagtcgctgagcaaatatttgttgaataatgcatcagcagatgactgaatttaactgtgaaagcagttgtttttttgtagttctgaggggtggcccttggcccttgtaggtgagtggtaagcagtgttgagggagggtcttcttagttccagaaaccacaggaagctgcacgatggaggaataggaaccagtggaagacacacctgtgttagaatgaggacaccaacagggtttcatggagctttgtgttttgaataatgcctgtttttttatgtgtagtgaatgatgctacactctgggtggactttgcctaagtttcataaatatttaattggctttttcaggagaataaaggcagccccgttgatgactgaaaatgacaaagcatccacctaacagacgaggaatcagctttgaagtgggagcccagttggaagcccgggaccgtttaaaaaactggtacttttacatttttctgttaattaaagcccttcagtaaaggatttttgccagcactgatagagtggtagcttaggctttttttgtggtgtttttctacttcctgactcttggaagatgtgaggaaatgtcagtcttttctctttgatgcagggatcccagtgtcagggtgactgtcctgtaaccccctgtatatatttgtttcccccttttgcctgttcatctgaaagagttctgggaaaaagaagcaggaatggctacagggaagggaagagttaatagtggcagctctcttgctcctggctgcctgtctgaaaaaagaggaaagatcagggatggaatagtgaagaaaaaggggttcgattggagcagctcatgtgttgtgaacaccccatcctattttctgggcatgatcttgtatgttgaaatacagtcatcatgtaagggcacactgtcagggtgattaggttcagaagctgaggggttatagtcccagctgtgtcattgacttgtgacctctggctggtaattagctgctttgtgcattggcttatctataaatgtgggtattggtaatattgacctcatagggttattctgagaatcaaatgatagaatatgtaaggaaagaccttatagactgtgaagtgattgttgtggttgagggcatcctagaatttggtcattttttggtgctcaaggtgagcgtggggttttcagaacttatacctctttaagggtttttgttttttttttttagacagagattcgctctgtcacccaggcagatcttggctcactgcaacctctgcctcccaggttcaagcagttctcgtgcctcagcctcctgagtagctggtattgcagatgtgtgccaccatgcctggctaattcctttttgagctaaagaaggaagagtttaaccctttttgagattctttcaaaatagattgatcagctcttcaggtgtaggaagataagacaggagaagagaggcatagaagcagctggtacagaaaactgtctttgctattagaattaggtacacttggctgggcgcggtggctcacgcctgtaatcccagcactttgggaggccgaggtgggtggatcacctgaggtctggagttcgagaccagcctggctaaagtggcgaaaccccgtctctactaaaaatacaaaaaattagccgggcatggtggtgcatgcctgtaatcccagcttctcgggaggctgagccaggagaattgcttgaacccgggaggtggaggttgcagtgagccgagattgcaccactgcactccagcctgggcaacagagtgagactcggtctgaaaaaaaaaaaaaaaaaagaattaggtacacttggccagttgtggtggctcacgcctataatcccagcactttgggaggctgaggtgggcggatcacgaggtcaggagttcaagaccagtctggccaacataatgaaaccccgtctttactaaaaatataaaaattagccgggcatgatggtgcacgcatgtagtcctagctactcaggaggctgaggcaggagaatcacttgaacctgggaggtggaggctgcattgagccaagatcgcgccactgcactccagcctgggtgactgagcgagactccgtcccggaaaaaaaaaaaaaagaaaaaagaaaaaataattaggtaattaggtacattttcaacacagttgtttttgggctattttttttttttggagacaagagtcttgctctttcattcaggctggagtgtagtggcgtgatctcggctcactgcagtctttgcctcctaggttcaagcaattcctctgcctcagccttctgagttgctgagattacaggcatgcaccacgatgcccggccaattttttgtatttttagtagagacagggtttcaccatgttggccaggctggtctccaactcctgacctcagatgatctgcctgcctcggcctcccaaagtgctgggattacaggcgtgagccaccaagcctgcctgtttttgggctatttgtattatctataattagttccttttttggtttcagtatatatatatgtgtgtgtgtgtgtgtgtgtatatatataatatactgcgtgtgtgtatatatattatatattgtatgtatatatattatataagtagtatcatacaacttgttttttttctgtgtctttgttttttatattcaatatgtttttgtgatttacccatacttaactccgcaccctcctcgcccacccctgatatagggtcttactctattgctcaggctggagtgtaatggcacaatcatagttcactgtggcctccaactcctgggctcaagtgatcctcctgccttagccctccatgtatctgggactacatcttaacttctgtatagagttttattgtatgaatataccacattttgtttatctagtcccctactaatggacgtttgtttgtttgtttatttatttatgatggagtctagctctgtcacccaggctggagtgtggtggcacaatcttggctcattgcaacatccgcctcctgggttcaagcagttcagcctcagctgggattacaggtgcccaccttgccaagctactgtatgttttttttttttttttttttttgagacgtagtcttgctcagtcgcccaggctggagtgcagtggctcgatctctcctcactgcaagcactgcctcctgggttcacgccattctcctgcctcagcctcccgagcagctgggactacaggcacccaccaccatgcccaactaatttttttgtatttttttagtagagacggggtttcacggtgttagccaggatggttgcgatctcctgacctcgtgatccaccctcctcggtctcccaaagtgctgggattacaggcgtgagccaccgcgcccagcctaatttatgtacttttagtagagatggggtttcgccattttggccaggctggtctcaaatttgtgacctcaggtgatccacccaccttggcctcccaaagtgctgggattacaggtgtgagccaccgctcctggcccgtttatttatttattattttttattgtatttttttttaaatgggtgcttaaattccagtttttcacctgagacacagtgctgtgtgaatgtctctttgtgcacatacacagacttttacttgggcagtggcttttgaccacaacctacagtaagaaatgtattttaaatccagtgtggtactcaaccatatgtacataaaaatttatttttattttgtttttattattatttttttgaaacgctgtcgagacagcgtctcactttgttgcctaggctgtaatgcagggtcgtgatcttggctcactgcaatctccgcctcccaggttcaagcgattctcgtgcctcagcctcctgagtatgtgggattataggtgtgtgccaccatgcctggctattttttttttatttctagtagagccggtgtttcaccatgttggccaggctggtcttgaactcctggcctcaggcgatctgcccaactcggcctcctgagtgctgggaccacaggccagatccatggcacccggcctatttttatttttccagacaaggtctcattctgttgctcaggttggagtgcagtggtgggaacagagctcattgcagctttgacctcccttggcttaagcagtcctcctgcttcagctgggaccacaggcacatgccaccacgcctgattttttattattattattattattattattattattattattattattttgagatggagtcttgctctgtcgcccaggctggagtgcagtggcgcaatctcggctcactgcaagctccgcctcccgggttcacgccattctcctgccttagcttcccggctaattttttgtaattttagtagagacggggtttcactgtgttagccaagatttacctcgtgatctgcccgccttggcttcccaaagtgctgggattataggtgtgagccactatgcccagccacacgcctgattaatttttaaatttttagtagagatgaggtctcactatgttgccaaggctgatctcgaattcctgggctcaggtgatcctcctgccttggcctcccaaaatgctggggttacaggcataagtcaccatacctgatctatataaatttaactgaaacacaaattttatgaagtagtatttaaccttaatacatgcattatactctggtatttttttcagttcttttttttttcgtttgggacagagtcttgctctgtcgcccagtctggagtgcagtggcacaatcttggctcactgcaacctccacctcctcctgggttcaagcgattctcctgcctcagcctcctgagtaactgggattacaggcgcccgccaccacacccagctaatttttgtatttttagtagagacagggtttcactgtgttggccaggatggtctggaactcctgaccttgtgatctgccctcctcagcttcccaaagtgctgggattacaagcgtgagccaccatgcctggcatttttttttttttttttttgatatgtctcactctgttgcctaggctggggtgtagtggtgcagttacaactcattgcagccttgacttccaggctcaggtgatcctctcacctcagccttctgagcagatgggactaccagcacataccatcatgctaggctaattttttgtatttttagtggagatgaggtttcactatgttggccaagctggtcttgaactcctgacctcaagtgtttcacctgcctcggcttcccaaagtgctgggattacaagcgtgagtcaccatgcctggcacatatttaggtttttaatccacctggaattcattttatgtgtagtatgaacttgtatctaattattattttttaattcaatgaataaccagttgctccaatatcatgtttagaatagtccattctttccctattgacctgcaataccacttgtatgtactaagcctcatatttacataggcctgttctcagatctttagtctattccattgatttatgtttactcctgtgcttgtaataacacattatttaattgatattgctttaacataactcttgatatctggtaagacaggttttattttatttgttgtattcttagacctttactcttttttttttttttttttttttgagacggaatcttgctcagtcgcccaggctggagtgcagtggcacgatcttggctcattgcaagctccgcctcccgggttcacgccattctcctgcctcagcctcccgggtagctgggactacaggtgcctgccaccacgcccggctaattttttgtatttttagcagagacggagtttcactgtgttagccaggatggtctcgatctcctgaccttgtgatctgcccgccttggcctcccaaagtgctgggattacaggcatgagccactgcacccggtcaacctttactctttaatgtgaatttttgtagtattgttgagtgtcttgaaaagtgtttttggagttttgaagtaaattgtatttaattggtatcttgataaaaagttttcattcatgaaaatacatctttatacttattcatgttttactttatgaactttagtgatgttttataacctccataaagattttgcatgttatctgttagatttattcctaagtactgtctagtttttgttgcttctatgaatggatcttttttttttttttttttttgagatgaagtcttgctctgtcacccaggctaaagtgcagtagagcgatttgggctcactgcaacctccgcctcccaggctcaagcagttctccctgcctcagactcccgagtagctgggattacagatgcccgccaccatgcctggaatttttgtatgttttagtagaggcggggttttgccattttggccaggctggtcttgaactcctgacctcaggtgatctgctcacctcggcttcctaaagtgctgggataacaggcgtgagccactgcacctggccagatctttatatatatattttttctctttggttattgctggcatgaaggaatattgttaaccaaattcagtatgtggattttatatagtttgaaaacaaaagcagactgcttaaaaaagatttatgacatttatgagattgttggaagtttgaacattgattggttatttgatattaaagaatcgttaacattttagatgtggaagtgatattgtaattttgttttttaagagttcttatttcttagagattatatacctacatttatgaataaaatgatacattgtgatttgcttcaagataatatgaagattctgtaattatatgcagtaggaagaaaaaggagataatatgaagggggaaaagggtgggaagatagaggaagcaaaagcggccatgtgtaatgggtacatgagtctttattgctattgagtcttgtatctggtcttacacagaaacctttctccattttcatgttcatcttaatggttcttttggattttctacatagaccatcatgtatctgcaaacaactgttttgcctcttcctttccaatcctctgcttctcatttcttttcctttcttccttccttactttttttctttccttcccgttttcccttctgtgttcattgactaggatcatagcagcaagatgttaaatgacagtgatgatagcagccttccatagtttgttgtttgactttaacaggaacgcatccgagagttcaccattaagtatgatgtttatcataggatcatagtagatgtgtttagtcagattaaagaagttcatgcctattccttgtttgctggaagttttttttttttcagcctgagtaatgttgaatttaatgcttttgggcatctaattaactggccatgcgtattttcccctttaatcttcatttatttatttatttttatttttattttttgagacggagtctcgccctgtctcccaggctggagtgcagtggtgcatcttggctcactgcaagctctgactcctgggttcgtgccattctcctgcctcagcctcccgagtagctgggactacaggcgcccgccaccacgcctggctaattttttctatttttagtagagacggggcttcaccatgttggccaggatggtctcgatctcctgacctcgtgatctgctcgcctcggcctcccaacgtgctgggattacaggcgtgagccaccgcacctggccccaatttttttttttcttaaccgtgtctttatggaaaagaggaaaacgttatggccatcttgtacaaatttctaggaacaaattttaaacttaacatttggccagatgcagtggctcatgcccgtaatcccagcactttgggaggccaaggcgggtggatcatgaagtcaggagttcaagaccagcatggtgaaaccccgtctctactaaaaatacaaaataaattagttgggtgtggtggcacatgcctataatcccagctacccctgagtctgaggcaagagaattgcttaaacctgggaggtggaggttgcagtgagccaacatcacgacgccattgtactccagcctgggcgacagagcaaagctctgtcttggaagaaaaaaaaaacaaagtttcaacttaacatttaaaagatattctgggcctggtgtggtggctcacacctggaatcccagcattttgggaggccaagcctggtggatcacctgaggtcagcagtttgagaccagcctggccaacatggtgaaaccctgtctctactaaaagtacaaaaatcagtcagacatggtggtgtgcgcctgtagtccaagctacttgggaggctgaggcaggagaatcgtttgaacctgggaggcagaggttgcagtgagctgagattgtgccactacacttcagcctgggtgacagagcaagactttgtctcaaaaaaaaaaaaaaagataatccagctgggcatggtgactcatgcctgtaatcccagcactttgggagggtgaggtgggaggattgattgagtcaaggatttcaagaccagcctggacaatataatgagaccctgtctcaaaaaaaaaaaaaaaattctgggcatggtggtacatgcctgaagtcccagctacttgggaggctgaggcaggaggactgcttgagcctaggagtttgaggttgcagtgagctgcaattgtgctgatagccgcaggtggcagtcaaatgcctaggcagatagggacagttccctggtgaaacctgactgtcaaaccaaggacagtttgtttgtttgtttatttattttttgagacggagttttgctcttgtcgcctaggctggagtgcagtggcgcgatctcagctcactgcaacctccgcctcctgagttcaagcgattcttctgcttcagcctcccaagtagctgggactacaggcaggtgccaccacacccagctaatttttgtatttctagtagagatggggtttcattatgttggccaggctggtctcaaactcgtgacctcaggtgatctgcccgcctccgcctcccaaagtgctgggattataggcatgagccactgtgcctggcctccaaagacagtttaaagcctgaaagccaagctacaagtcctgggtaaatccacggactggattgagaacctctcttccagttcggcaaggtttcctctgattgatccccacccttcacctgttttacatgtatttactcttccctgattggttttttacactgtcatgcccacctttgagtgacgcctttgttttagcctttttgttatatgcacaaaccaatcagcatacattccccattctgaacccataaaagccctgccacactgagagggagactacctgtcttcaagtgggagagtaccctcatgtgggtgctcttatgagcctcattttagcagtaagaaaaaggagtctcagagagatgaagttatttgcccaaggtcacacagtggtaggactagggtttgaatcaaagtagactgagttcatagcatttttgtaataaccaaatttctccagagtgtctgaatgttcctgactcctaaatcaaaaaacaaaacaaaacaaaacactggaaaatgcattctgattatgttcacctgatttcctaatctagagtactggacatttaattgtttggtaaaatctttgactttgaatgctttgccaaaaacaatggagcgtttgttttattatctctagactgaaagtggttatgttttcaccctggtaagtgatttgcttacattatagtagatagtattgctgcaaggtacaaccatattttttgtgtgtgtctgtgtctctctgtgtgtgtatgtgtgtattttcagtccattgaaatgaaatgtgtgggaattaggttccactttttttttattttcatttttttgagacagagtcttgctctgtcgccaggctggagtgcagtggcgtgatctcggctcactgcaacctccgcctccagggttcaagcgattctcctgcctcagcctcccgagtagctgggactacaggtgtgcgtcaccacgcccagctaatttttgtatttttagtagacatggggtttcactatgttggccaagatgatcttgatctcttgacctcatgatctgtccacctcggcctcccaaagtgctcacattacaggcgtgagccaccacgttgggctagggcccactttttaattgcttatgtccttgtgacttcttgcctctgaatccttgaattatttgttcttatttttgggccctaaagaaactaagtcccagcttttttttttttttgagatggagttttgcttttgttgcctaggctggagtgcaatggcacaatctcggctcactgcaacctctgcctccctggtacaagcgattcttctgtctcagtctcccaagcagctcggattacatgcatgcgccaccacgctcagctaattttttttgtatttagtagggacagggtttcaccatgttaggctggttgagaactcctggcctcaggtgatccacctgccttggcctcccaaagtgctgggattataggcatgtgccactgtgcccggcccagtccctgctttttatttatttatttatttttattttttaatttttttgagacggagtctcgctctgtctcccaggctggagtgcagtggctcgatctctgctcactgcaagctctgcctcccgggttcccaccattctcctgcctcagcctcccgagtagctgggactacaggcacccgccaccacgcccggctaatttttttgtatttttttaatagagacggggtttcaccgtgttagccaggatggtctcgatctcctgacctcgtgatccacccgcctcagcctcccaaagtgctgggattacaggcatgagccacagcgcccggcccctgctttttattaagaaaattttctaacataatgaaaagttgagaggacattataccttccacctgtattcactaattgttaacccatttgttttatatacttatttaatttagcaataattttataatatctaatatccagagatattcagatgttcttgttgttccaaaaatgtcccttatagtatttttccagacaggatccacattacttttttatttttatgtctctttagttgctttgattccatgataatctttcttcttcccgggaggcagagcttgcagtgagcagagatcgagccactgcactccagcctgggagacagagcgagactccgtctcaaaaaaataaaaaaatttttccccttcacaacattatttgtttaatttttaagagttccgaacagttgttttttagaatgtcccacattctggtttagtcacattgttttatcatggtgagtttaacttgtttcttgtattctcttctatttcccgtaaactggaaatgaggtctagacttcagattaaacattttttttgcagagtgtttcagtggtaatgccgtgtgtttcatattgcatcacatcgggggacacataaagctaggtcgtcccactgttccgtgtatcacttggataaggtaatgacttccatctctcaccattataaaggtgtatttttccttgtgcaagtagtagataatctgtggggatactctggtacgtgtcaatatcctattatccccccacatcatttacctaatgatttagcatccattgataatccctgcctgaatcagttattactctggagatggaaaaatggtaatattctagttttgtcattctgttatattaggtgatgttcttctgtacgaacagctttcatttttattattattatttttgatacagagtctccctctgtcgcccaggctggagcacagtggtgcgatcttggctcactgcaagctctgcctctcaggttcacgccattctcctgcctcggcctcccgagagctgggactacaggcgcccgccaccacgcccggctaattttttttgtattttttagtagagactgggtttcaccctgttagccaggatggtctcgatctcctggcctcgtgatctgcccatctcggcctcccaaagtgctgggattacaggcgcggtgagccaccgcgcccggcccatttttattcttttaaagtgcacttaggaataagattattgagtgtggtggtgtagtcaattccattcattattattaattttgtgctaaaattatcccaaatttgtccagtgggatgctgtttaaactagctcctttgttcttttgacaattcctgttagtcccttagcattttcttgttttctggcactactagaaaccccaaacttactttctacttttcttatcccagaccctggacgcagctggttctccaaggcttggtttctttaattaggaaagggtatttagaaattgacctctgagctgggcacggtggctcacgcctgtaatcccagcactttgggaggcctaggcaggtggatcagaaggtcaggagttccagacaagcctggtcaacatagtgaaaccctgtctctacgaaaaatacaaaaattagccaggcgtggtggcacgcacttgtagtctcagctactcaggaggctgaggcaggagaattgtttgagcctgggaggtggaggttgcagtgagccgagatagcgccattgcactccagcctgtgtgtgagccaagatcacaccattgcactccagcctgtgtgtgagccaagatcacaccattgcactccagcctgggtgacagagtgagactccgtctcagaaaaaaaaaaaaaaaaaaaaaaaaggaaattgacctctgaggttgaggctgcagttagctatgatcacaccactgcttgggtgataagaataagactctatctctaaataaaataaataaataaataaataaaataaaacattggtttttaaaaaaagaaatttagctctgggcactgggtgtgtttattgctgctaggatgtcattgtcttaaacaactttttagtagatgggggtaagaaatctattttttgaaaaaatgtgagttcactttgatacttccaatttatttatttatttttttgagatagtcttggtctgtctcccaggctggagtgcagtggtacgatctcggctcactgcaacctctgcctccctagttcaagcaattctcctgcctcagcctcccaagtagctgggactacaggcgcatgccaccatgcctggctaattttgtatttttagtagagatggggtttcaccctcttggccaggctggtctcgaactcctgacctcaagtgatccgcctgccttggcctctcacggtgctgggattacaggcgtgaaccgctgcgcccggcctataatattaaatttaagttggaaatatcaggcctgggtaacagagtaagacactgtctcaaaaataaataaataggccgggcgcggtggctcacgcctgtaatcccagcactttgggaggccgaggcaggtggatcacgaggtcaggagatcgagaccatcccggctaaaacggtgaaaccccgtctctactaaaaatacaaaaaattagccaggcgtagtggcgggtgcctgtagtcccagctacttgggaggctgaggcaggagaatggcgtgaacccgggaggcggagcttgcaatgagccgagatcccgccactgcactccagcctgggcgacagagcgagactccgtctcaaaaaaaaaaaaaaaaaataaaataaataaataaataaataggccatgcatagtagctcaagcctgtattcccagcactttgggaggctaaggtgggcggatcacctgaggtcaggagtttgagaccaaactggccaacatgatgaaaccccgtctctactaaaaatacaaaaattagccgggtgtggtggcaggtgcctgtaattccagctactcgggaggttgaggcaggaaaattgcttgagccaaaggaggcagaggttgcagtgagctgagattgcgacactggactccatcctgggtgacagagggagactctgtcccccgaaaaattataaataaataagtaaataaatagatgaaacaaaaagaactaacatagaatatgcatggtgtaactatgctaaatgaaactcaaaatatggccagacacggtgactcatgcttgtaatctgggcactttgagaggctgaggtgggcagatcacttgaggtcaggagttggagaccagcctggccattatgacgaatccatgtctctacttaaaatacaaaaaattagctggacattgtggcatgtgcctgtaattcttttattcttttttttttgaggcagagtcttgctgtgtgtctcccaggctggagtgtagcgcgagtgatctcagctcactgcaacctccacctccctggttcaggtgattctcctgcctcagtctcctgagtagctgggactacaggcgcatgccaccatgcctggctaattttttgtatttttagtagaggcagggtttcactgtgttagccaggatggtctcggtctcctgacctcgtgttccacccgcctcagcctcccaaagtgctgggattacaggcgtcagccaccgcgcctggcatgcctgtaattccagctacttgggaggcctaggtaagaggatcacctgagcccagaaggcagaagttgtagtgagccaagattgcagttgagactctgtctcaaaaaaacaaacaaacaagcaaaatcgttttggaaatacatatatattccccctccagctttattgagatataattgacaaaaggcatttatatatttgtttatttttgagatggagacccgctcagtcccccagactagactgcaggggctggatctcagctcacagcaacctccatctccggggttcaagtgattctcctgcctcagtctcctgagtagctggaactacaggcacgcgccaccatgcccagccgatttttgtatttttagtggaggtggggttttaccacgttggccaggatggtctcgatctcttgacctcgtgatccacttacctcagcctcccaaagttctgggattacaggcgtgagccactgcacccggcccgaaaatctttgttcctaatcatactttaacctacttgccttattctgtgttatatgtgaaatagttttaaagttacaatatcaatattactattaacaagtatactgagtgaattttaaggattttttgacatttgaaaaatgtatatcttactcaggacaaattatatttgatttatgtcataaactttttttaagttttttttttttttgagacggaattttgctgttgtcatccaggctggagtgcaatggcgcaatctccggtcactgcaacctctgcctccggggttcaagcgattctccagcctcagcctcccatgtagctgggaatacaggtgcctgccaccacacccagctaattttattttgtaattttagtagagttcgggtttcactgtgttggccagactggtcttgaactcctgaccttatgattcgcccgcctcagcctccgaaagtgctggaattataggcgtgagccactgcgcccggccgatttatgtcataaacttaatccaaaattaaatgagttttttttttttcttcttctttgagatggagtcttgctctgttgcccaggctcgagtgcagtggtgcaatttcggcttactgcaacctctgcctcctgggttctagcgattctcttgcctcagcctcgtgagtagtgggattacaggcgtgcaccactacgcctggctaattttttgtatttttagtagagacatggtttcaccatgttggtcaggctggtctcgaactcctgatctcatgatccaccctccttgtcctcccaaagtgctgggattacagacgtgagccactgcgcctggccataagtgttgttgttgtttttttttaatctgttatgtgaactaacagttctttcttttttttttaaatactcctacagtctaattttatttccgcatttatttatttatttatttgagacagagtctcattctgtcacccaggctggagtgcaatggcgtgatctcagctcactgcaatctccgcctcctgggttcaagagattctcttgcctcagcctcccaaataggagggattacgggcccctgccacggcgcccagctaatttttgtatttttagtaaagatggggtttcactaggttggccaggctagtcttgatctcccgacctcaggtgatccacctgcctcggcctcccaaagtgctgggattacaggcgtgagccaccacgccagacctatttctgcatttaaattatttttggggccaggcatggtgtcccacacctgcaatcccagcactttgggaggccaaggtgggcatattgctttgagctcaggagttcaacgacagctgggggcaacatggcaaaaacctgtttctacaaaaaataaaaaagttagctgggtgttggtagctcctggctgtagtcccagctactcaggagacaggctagagaatcctttgagcccgggaagcggaggttgcagtgagcccagatcgtgccactgcattccatcctgggtgacagagtgataccctgtctcaaaaaaatttaaaaaataaaattattttttggccaggtgttgtggcttatgcctgtgatcctagcatgtttagaggctgaagtaggcagatcacttgagcccaggagttcaagacaagcctgggcaacatgacaaaaccccatctctacaaaaaaatataaaaattatatttttataattaaagtataaatttaattataattaaattacaggcatggtggctcacacctgtaatcccagcactttaggaggcctaggtgggcagattacttgagttcaggagttcgagaccagcctggccaacatggtgaaactccgtctctactaaaagtacaaaaaaaattaggcgcatgcctgtaatcctagctactcaggaggctgaggtgggaggcttgcttgaacccaggaggtggaggttgtagtgagccgaaattgcgacactgcacttcagcctgggtgacagagcaagactccgtctcaaaaaacaaaacaaaacaaaacaaaacaaaaaattagctgaggtggaaggattgcttgagcctgagaggttgaggctgcagtgagccatgatcctcctacttcagcctcctgagtagctgggactacaggcatgtgccgccacccttggctaagttttgtattttttgtagaggtggggtttgccatgttgcccaggctggtcttaaacttctgggctcaagcagtgcacccacctcatcctcccaaagtgctgggattacaggtgcctggcctagcatttttgagacagagttttgctctgtcaccaaggctggagtgcagtggtgtgatcataactgtagcctggtactcttgggctcaagtgatcctcccacctcagcctcctgagtaggctgggactataggtgcatgccactgcacctggctcatttttgtatttgttatagagactgagtctcgctgtgttgcttaggctggtctcaaactccagggctcaagtgatcttcctaccttggcctcccaaagtgttgggattacaggcatgagccactgcacctggcctatattctaatttttaatctaccactttggggtgaactttcagcatgtccattttcttctctgtagaaggggtaatcctgccttccctgtttttgttttgttttgttttgttttgagacagtcttgctctgctgcccaggctggagagcagtggccctatctcggttcactgcagcctccatctcctgggttccagcgattctcctgcttcagcctcctgtgtagctgggattacaggcatgcaccaccacacccagctaatttttgtatttttagtagagacatggtttcaccatgttgaacagcctggtctcgaactcctgacctcaggtgatctgcccgcctcagcctcccaaagtgctgggattacaggcgtgaaccactgtgcccagccctgccttccctatttgcttcctgcgttttatagatgaactaaaatctgagaggctgcagtttcctagtagtgatacttggtggatagaatagaatctgcttgctctgctgccttcgccttcttcctgtcatctgtcaggagtgtgccatctgttccaagaagtaggctggccttccctgttcttgctccaaacacaacgaaaaagctccttctgttgctttcctgacactctggtacctttccactactgtgtttctatttaagttgatcatagttcgcttccatttcttgtacagaagatttaaaaatctgagtttcataatgtccttagatcatttttggtttctttttcattagggttatttgtactgatctcatctgagtttctggttcatacctctttactccttacaccatctgtgtgtgtgtgtgtgtgtgtgtgtgtgtttttaagcaatcttttctgagctttccacaaacatgtattgaatgctgtgagtcaggtggtacactaggtgctatgaaatgaaggaaaataagtacttcaagatgttcagagacgagtcaagtatttggctttggtttttagtattgatagccaagggtcgttaatcatgtattctaatgcttatgtctttgctagtgactcacatttattgagtgatttactctgtgccaggcacaaatctaaaggctttatatgttatacctcctttaatcctttagatgctatgaagggggtacttttattctactttatatatgaggaaatagaagcagaaagcagttaagttttccagtgctatgtagctgtaaatggtgaatttaggatttgagtctagctagttggcttctgagcatggtcgggtgtggctttgatccccacgcatgtgttcagtacctagaataaagtccctgaaattaaatatattatgaggagatatttactctgtacaaagttcatttacaaaaacccctaggggagaatagttaatttcatatgtgggaatttcagaaggcttcagaaagatgacttttgatgccaagtcattcattcaatgctagatgctggagaaatagtggtgattaggacagacatagtccctgatctttagaagctgacattccagtggaggtggatagaacagaaaccagcagactgatatatatagataatgttaggtggtgataaatgctagaaagtggaataagtactttttttttttttttttttgtgagatggagtctcactctgccacccaggctggagtgcagtggcatgatcttggctcactgcaagctccgcctcccaggttcacaccattctcctgcctcagcctcccaagtagctgggactacaggtgcctgccaccatgcccggctaattttttgtattttttagtagagatggggtttcactgtgttagccaggttagtctcgatctcctgacctcgtgatctgcctgcctcagcctcccaaagtgttgggattactggtgtgagccatcacacctggccagaataagtactttcaagtgggtagagtgcctctatgtgtgtatgtgttttgctttttttatatagagggtgaacagaggagatctctctgacagacatttaaatagagtcctaaagtaagtgagggagtgagtcatgttagtatccagaggagagagggttgcagacagaggcagccaaggcagaagccctggcgtaggagcaagcagggcattcaagcaataataggtaggaacatgtggctgggagggtagagagtgagaggccagaggtaggaggtgagcccagaaaggtcagcaggggccagatcggccataataaggagtttggactttattctaaatgtgatagtaagtcattgaaaggtcttaaacagggaatcaatgttatctgatttcaagtattaaaagtggctgtgggccaggtgcagtggctcgcacctgtaatcccagcagtttgggaggccgaggtgggtggatcatttgaggccaggagtttgagaccagcctggctgacatgtactaaaaatacaaaaaattagcctggagtgttggtgggcgcctgtaatcccagttactcaggaagctgaggcaggagaattgcttgaacccgggaggtggaggatgcagtgagctgagattgtgccactgcattccagtctaggcaacaagagcgaaactctgtcaaaaaaaaaaaaggggctgtgagcctaggcaatatagcaaaacgctgtctctaccaaaaatacaaaaaaaaaaaaaaaagccaggcatggtggtgtgtacccgtggtcccagctacttgggaggttgaagtgggagaatcacttgaacctgaggggcagaggttgcagtgagctgagatggtgccacttcactccatcccaggtgacagagccagaccctgtctcaaaaaaataaagttgctgtggttattgtgtgtagaatatgctgtaggcagccatgggcagaaacaagaagagcaaggatcttttgtattagtccatgtgaaagatgatagttgtttgaactaaaaagcagtgggggagttgatgagaagtgatcagcgtctgtataatttttgaaggtacagctgacagatttgctgacgacatgtaagagatagagaagagtcaaggatgactccaagggctttttctctcggtaccagtagatggaattaccacatgctgaaatggggtagacttcagtagaactaggttctagggagatgataagcagtttggttttgggcatgttaaatatatgagattcctttgagatgactaagtggagatgttgaatggatagttgaataacagagtcagatgttcaagtgtgagccctgggttagagatagacatctgggagttgggctgagtgcggtggctcacgcctgtaatcccaggactttgggaggccaagacggaagatcgcttgaatcccaagatcgagaccaacctgtgcaacatagtgagactctgtcttacaacacatatatacacaaaaaccccaagaaacctagctgggcatggtggtgtgagcttgtggtcccagctactggggaggctgaggtaggaggatcacttgagctagggaggtcaaggctgcagtgagctatgattgtgctgctatactgtatgattgtgcttgggtaacagagcaagaccctgtttcaaaaaaaaaaagaaaaaaagtaaaggaatttgggagttggtaatgagtaaatgggattaaaaaaatagactatattttagagcagttttaggttcacagcaaaattgagcagaaagtacagagttctggctgggcacagtggtttatgcctgtaatcccagcactttgggaggctgaggtggaaggattgcttgagcccaggagtttgagaccagcctggacaccattgcaagaccctgtctctacaaaaaataaaacaaattagctggggtagggggtggcttgcacctgtagtcctagctacttgggaggctgaggtgggaggatcgcatgagcccaggagtttgaggctacagtgagccatgattatgccactgcatggcagcttgggtcacagggtcacagagcaagaccctgcttctaaaaaaaaaaaaaaaaaaaaaaaaaaagaatgtatcaagttcccatattcctgtgttctccctccagcctcccccactttcaacatcctgcaccagagtggtacatttattacagttgatgaaccaatattgacacctcagtaccacccaaggaccatagtttgcattaaggtttgctgctggtgttgtattgtttatggattttgacaaatgtataatgtatatgtgtatgttacacatttatcaaaatccatatgtgtacattatacatttgtcaaaatccataaaagttacaaaagtacaaaaaaagtacaatattcataaaaagacaacttgatgctcaaaaagtttcggattttggatgtttggatttgagatgctcaacccatagtaaaattcgctctttttcagaatacagttgagttttgccaaatttgacagttcacgcaagccccaccacaatcaagatatgggccgggaatggtgactcatgcctataatcccagcaccttgggaggacaacgtgggaggattgcttgagcccaggagttcaagacaagcctaagcaacataatgggacttcgtctctcaaaaaaaaaaaaaaaaaaccataataaaagtaataataatagctgggtgtggtggtgtgtgtctatagttttagctactcaggaggctggggtgggaggaagactgcttgagcccaggaggtcaaggctgcagcaagctgtgattgtaccgctgcactccaactccagcctgtgtgatagagcgagaccctgtctcaaaaaaaaaaaaaaaaaaaaaaggggtgaagaaagaaaaaaaaagatataaagcacttctgttacccacagaatttcctcatgtccatttgtaatcagcctctcctggcacctccagctcctgtcacccactgatctgtcctttgtctatacagttttgccttttccatagtgtgttataatggaattattcagtacatagccttttggatttggcttcttaaacttagcgtaatgcatttgagactcacccgtatttttgcatgagcaaaataaagggttgttgcttttagaaccaagtagtaagtattccattggatggatataccacagcttatctgtttatgtgttcaaagacatatggattgtttccagttttgggttaatatgaataaacatttatatataggtttttatgagaatataagttatcatttctcttggataaataccagcgagctggattgctgggtcatgtaagtgtatgtttaaccaggtgagaaaccgccaaactttttcagagtctctgtaccattttgcatttccaccaggaatgtcaggaatgtatgagaattccagttgctctgcattgttgtcagcacttggtgggattcttttttttctctcctttttttttaattaactgttttaaaaaattgagatatagtttacatgttataaaattcatccttttaggctgggtgtggtggctcacgcctgtaatccaagcactttgggaggctgaggtgggcggatcacaaggtcaagagatcgagatcatcctggccaacatggtgaaaccctgtctctactaaaaatacaaaaattagctgggtgtggtggcatgtgcctgtagtcccagctactcgggaggctgaggcagtagaatcgcttgaacccgggaggcagaggtttcagtgagccaagatcacgccattgcactccagcctggtgacagagtgagactctgtctcaaaaaaaaaaaaaaatttaccatttcaaagcatacaattcaataattcaatggttttcagtgtatttacaaagttgtacaattgtcaccactatctaattccagaattctcattatcccaaaaagaaacctcatacacattagcagtcagaccctatttcctccctgcccttcccagcctaggcaaacacgaatttactttccctctatatatatgcctgttctggacatttcatagatatggagtcatacagtaggtgactagctgctttcacttagcatgctattttcaaggttcatctatgttgtacgttactgctttttgtggatgaataattccattatatgagtataccatattttgttttcccattcatcagttgttgggtatttacagtgtttcttctttttgggtattgtgagtacacatttgtgtggacatatgattttacatcatatgggtatatacctaagatggaattgtcagatcatatggtaattctgtttaaccttttgaggaactgctaaattgcttttcgtagtagctgcaccattttacactcccaccagcaatgggaatcctgtttgtttttattttgaagagatgggagtcttggtattggcccagactggactcaaactcctgggctcaagtgattgtcctgcctcaggcctcctgggtagttgggactgcaggtgcataccaccgtgcccagctattttttacattcaataagaagtaaaattatcagctgagactgagatcaggacagggagggcttaggtttgaggaaagaagataaggtatgaaatatttaggagtttgcactccctcctcaggctccactttactcagtagctaatgacaggcctcaaactcctggcctcaagttatcctcctgcctcggcctcccaaagcactggggttacaggtgtaagctaccatgcctggctaaaaacttttttgatattaattttcctggctccttaaaggtataagacattgaattaagaagagtgcaaaattgctactctataattaggttaattatttttagagagagggtcttgctttgttgcccaggctggagtacaatggctatttacgagtgccatgaaatacactacagccttcaattctttggctcaagcagctctcttgcctcagcctcctgtgtagttgggattataggcatgcactatagcacccagctcttacacttttattttaaaaatactttttgttgagttttaatttatagtagagtgtataaaccctaaatgtgtagcttgatgaacttttacatatgtatacacttctatagccaccacccaaatcaagatatggaccattatgggcactccggaagcttttttgtccctctcctacccccaaagagaattactgtttaatacctgtttgcagatatgcattttatatatgtatgtatgtgtgtttgagacagtttcgctcttgtcccccaggctggatggcagtggcacgttctcggcttactgcaacctccgcctcctgggttcaagtgatctcctgcctcagcctcctgagtagctgggattacaggtgcccgccaccacactcgactaatttttgtattttcagtacagatggggtttcgccatgttggccaggccgggctcgaactcttgaccccaggtgatctgcccgcgtcggcctcccaaagtgctgggattacaggtgtgagccactgcacctggcctagacatgcatttaaagtgagacccatcagcatgttgagtgttttctctagccacatttagctgtctgggtacaggaatggagaatgtggagtctgaaataaccagggttgggtggcagttgtgatgaggaagagagtcgccagtaatttgagggcatatgcaaggaagtgaaattaaagaatgagaagatttccaggaagagagtggcagggggagaaggcagaaggaataacatcagcaaaaatattcagggcttgaaagaacttggtgtgttctgagaatccagggaggtaacaggagtggtgggagattgaactgaagagtgaaaatttaagcaggagagagacatgttttgatccttcttagtaacagaaaattggcagtgttcattctgtcataagatatttgctgagtggctctgtatcaggcattctgctgggtactgatagaaggggtttaggggtgatgtgtacatactgactgttcagttgttgctggtaagaaatgattgagatagagaggaaagataaatttaagacctttcttatatcagatgttgattaatggaagtggtgaaggggtagggaaagagttaaggcattcaaaatagcagtttttctgcagtttaatagtcagccttttgttttttactaaatatatcttccatccccatctcctctccagcaaaggctggtgatggcttagaatgttccttttgtgcatagaagtattttgcttctggtatgtgccctgagccaggaatagaggcaagctctgattttttttcgctcttgtcgcccaggctggagtgcaatggtacgattttggctcaccgcaacctctgcctcctgggttcaggtgattctcctgcctcagcctcccaagtagctgggattacaggcatgcgccaccacgtctgggtaattttctgattcttgaagtaaaatgagtgctgtatgtttgcagacaaactgtttatatagcaaagaatctggaagcagtctgaatgcttaacctctgggggaaagttaagtcaaattctgggctagccacgcagttaagtagactattacatggctaagacaaaagacacccatgtggatgtggtgactgcaggaatgtttacatgtggagtccagttaagagcagaaggctcatagccgggtgcggtggctcacgcctgtaatcccagcactttgggaggctgaggtgggtggatcatgaggtcaggagatcgagaccatcctggctaacacggtgaaaccctgtcactattaaaaatacaaaaaattggctgggcgtggtggcgggtgcctgtagtccagctactcgggaggctgaggcaggagaatggtgtgaacccgggaggcggagcttgcagtgagccaagatgacgccactgcgctccagcctgggcaacagagcgagactccatctcagaaaaaaaaaaaaaaaaaagcagaaggctcttcaccgggtttagagttagatgtagatatcgatcttgattgtgcctcttcctagtcattctctttgaggctccatttccatgaatgtaaaaagggggcagtaataataatgactccttaagtcttcatggcatgatcaagtgagataccttagataaagatagtttacaaaccctagagtaagctgcactcattagttttatttatttatttatttatttatttctgagacagagtttcgctcttgttgcccaggctggagtgcaatggcatgatctcggcccaccacaacctccgcctcctgggttcaagcaattctcctgcctcagcctcccgagtagctgggattacaggcatgtgccaccatgcccaggctaattttgtatttttagtagagacggagtttctccattttagtcaggctggtctcgaactccaggcttcaggtgatccgcccgccttggcttctcaaagtgctgggattataggtgtgagccaccgcgcccagcctcattaattactaatagccatgtgggtgaacactgatgagttgtagtgggaattcggaaggaaattgtcatcctttctgtttttttctccccggccccatgatgtttctttagttagtatttctggtatataggggggaacaaaacagattcctgccaagcactgtctggctgctctagtttaagcacgtgcacggtatgtagtattaggcagcttaattttacacagatgcagcaagactctgagcggcaagccttcctggggcttaaggtcatatagggcaggcatgtcaacactgtttccctgaattagacctgtactgttctctgccttctggctgtgcacatggagtcatgccagcagtggcagtgctttactgtcttacagccctctctctcccttggtggagccctaggacatgttggcttatcttgtagcttagagcagtgtttctcaaacctgaaaacatgaggactggcacctctaacctataaactattgatagactccatttctagataccaaagcagtctagcaaaatgcaactttgttagctacttagtgctgtgtaacacattttctcaaaatttagtgtcctaaaacaataaacatttattattctctaggtgtctatgggccaggaattcaggagcggcgtaatggggggttgagggggcttctggcccaggatctcataaaggctgcatccaagggggctcactcacagggctggcaagttggtgctggttcctgacaggtggcctcagttccttgtcatgtgaacctctccatagacatctagaatgttctcacgatgtagcacctgacttaccctagaacagggaatctgagagagtgcagggcagaagcagcagtgctttgtgtatatgcttgtggtaaaatacatacaacataaaatttagtattttaatcatttttaggtgtgcagtacagttctgtagcgttaaatacattcacactgttctgcaaccattaccagcctacttctccaaaatattttctttctttcttttttctttttttcttggtgatagattctcactctgttgccaggctggagtgcagtggtgcgatctcagctcactgcagcttctgcctcccggtgattctcatgcctcagcctcccgagtagctgggattataggcttgtgccaccacgcctggctaatttttgtatttttagtagagatgatgtttcaccatgttggccatggctggtctgaaactcctcacctttggtgatccacctgcctcagcctcccaaagtgctgggattacaggcatgagccactgagcctgacctaaaatttttcatagtgagataaaatctcactatgttgtttatgttggtctcaaactcctggccttagccgtgcgccatggctcatgcctataatcccagcactttgggaggctgaggcaggcatattgcatgagcccaggagtttgagaccagcctaggtaacgtggaaaccctgtctctcctggcctcaagcaatcttcctgccttggcctctcaaagtattgggattataggtgtgagccaccacgcccagcccaagattttttctttttctttttttttttgagatggagtttcgctctgtcacctaggctggagtgcagtggtgcgatctcagctcactgcaacgtctgcctcctgggttcaagcagttctgctgcctcagcctcccaagtagctggggctacaggcgcatgccgccatgcctggctaattttttgtattttagtagagacggggtttcaccatgttgcccaggctggtctcaaactcccgagttcaggcagtccacctgcctcggcctcccagagtgctgggattacaggtgtgagccaccgtgcccggcctgattttttcatctctccaaactgaaaccctgtatctattaatcagcaactgcctcatcccttctccccttagctcctggtaacctctattctgctttcattaatctggctactctagataactcagatgaatggaatcatgcagtatttgtccttcaagtggcttatttcacttagcataagtcctcaaggttcatctgtgttgtagcatgtattagagttttattcctttttaaggctgaataatattccattgtatggatataccacattttatctattcatgtattagacacttgggtggctttttgactactgggttgtcttttgactgttgtgagtaatgctgtgtgaattctggagtacagacatctgtttgagtccttgtgttcagtgtttttggatatatacccagaagtggaattgctgcagtgcttttttttctttttcacatcaactttatagttagataatccatcactttattaattcagaagtttgctttttttttcccttcaactttttttttttaagttctggggtacatgtgcaagatttgcaggtttgttgcataggtaaacttgtaccatggtagtttgctgcacagatcatcccatcacctagctattaagcccagcatccattagctcttcttcctgatattctctctcccctgtcctgctgcagtgctttttataacccagctttggaagtcccacaccatcacttttgccacattctacttgttagaaatgaggccatattcaaggataaaacgattaaaatctaccttttgaaggaataagtgccaaatctgcagacatataaagttgtcccagctactatgtgggagtgattttataatgccaggttagttacaaatatacacactaaagttatttctttcttccttccctccctccctctcttcctccctccctccctcctttccttctcatttatttattttgggtctcactctatcacccagggtggagttcagtagtgcgatcatgactcaacacagcctcaaccttctgggctccagtgatcctctcacctcagcctcttgagtaactgggactacaggcatgcatcaccacatctggctaattaaaaaaatttttttttgtacagacagatggggtctccctatgtttcccatactgatctcaaactcctgggctcaggggatcctccttcagccacccaaagtgctgggattataggcatgagccattgtgctgggctgattaaatttttttagaaatagggtctcactttcttgcccaggctggagtgcagtggtgttgtgatcatagctcactgcagcctcaaactcttgggctcaagtgatcccccaactccaacctcttaagtagctaggactacaggcctggctaatttttaaaactttttgtagagacggagtcttcctatgctgcccaggctggtcttgaactcctggcctcctgccttggcctctgaaagcactgggattacaggtatgggccactgcgcccagccttacacactaaaattttctagtagttcttgattatatggtggtcatctggtatctcaacgttcttcatgtcattgcccacttgtaacccatttgtggtacctcagctgggaagctctggtaaagagggtccagattacagaaaagcacaatataatattcttcatccctcatggagaccttgtggaccagcagctctgtgttcaccaacacgcagtggtccgtggactgctcttggcaaacattcatttagggctcagcagcccatccataagatcctcctggcccctcaaacggagttgttgtttcctctatccccttgaatttccttgtcctcttttttgcctgctttcctctgtactatgctgatttactcctattacatcttctctcagaaactctccccagcttcactgcctctttgatcagctggaaaatgcctactcatctttcagaatggagatcaagtgtctcctcttccccagggttgtcttgggccctcctctcactcgatccccttcctctccctctccccttttgcacctctgtatcttactctaccttaaggagtcctctgttgttgcacctggtatactttattacaattatttgtacctatagacatacttagatacttttattcccccagactatactgtagtaagtaagagacagatgcctctagcagtgcctgttgtctcctggggaagcaggccataaacacaaacaaatgaaataatgacagattagggtaaatgctatgaaggaaacatataggaaactgacacagactggaaagaaatgggggctacttgagatagtgtagtcagagattctgaggctatgggaggataaggatgttgcctgggaagagtgggcagggattgttgtttcaggtaacgggagcatactcggtatgggaaggtgtgtggtgtgtttgaggaattgaaagtctactgtgtgttgtaacgtagggcctgtcatcctctgccagttgctgtgatcatgcatcttaatagatttggttctggccagatgtggtggctcacgcctgtattcccagcactttgggaggccaaggcaggtggatcacgaggtcaggagttcgagaccagcctggccaacatagtgaaaccctgtctctactaaaaatacaaaaaatgttagctgggcgtggtggtgggcacctgtagtcccagctacttgggaggttgaggcaggagaaacacttgaacctgggaggtggaggctgtagtgagctgagatcacaccactgtactccagcctgggtgacagagtgagactccatctcaaaaaaaaaaaaaaaaaaaaagtagatttgattctgtatttctaaaccctaatatacttcctggcccagagcaggtactcagaaaatgtttgtggaattatggttcaatgaatttttcttctgctgatttctgttcattctccttgtccttttccatttgacattggctatactggtcttctgtggcttcttggttggcttagtgaccagttatctgacttgcttaaattaagcttattacggtaaccttatttattatgaatttttgcttatctgtcctttccaggttgaattttagatgagagtttttgatgctttttggcctttggaaaacagttttgtgactaattttgtcatggtgaccaccatgtgcatatatcccctccaaattaagagttcccatactggggtatgtttgtcctcttgacatctacaacatgaatatcactggtttattttgatgattcatcttggtttgtttatatatttctattgctgttttgtggctccagatctttttaaaaattacatctggtgaacctttattgaatgtctaatatatgcaggataccctgggggagattcagactcttgatctctgaaggtttgatccaaaggctaagtcttctctgaaccctttcccaaccctctagttagaaaaaatgggactctgatgaaaaagtttaatgtgggctttagaatgaagggttaaaaaaaataaaaaatagaccaggcacagcggttcatgcctgtaatcccagcactttgggaggctgaggcgggcagatcacgaagtcaggagttcaagaccagcctggccaacatggtgaaaccccgtctctactaaaaatacaaaaattggccaggcatggtggcgcacacctgtaatcccagctactctggaggctgaggcaggggaattgcttgaacccgggagacagaggttgcagtgagccgagatcatgccactgtactccagcctgggcgacagagtgagattccgtctcaaaaataaataaataaataaataaataaaaaggcgggagggtttattcaagtgctttagaagggggcagggaagagcagcagaaacccagactgtccagcctgggctggacatggaggagagataatgcctctcttctgtctagtcctggttatgggatataggcaggctggttcattctacagctatggttttttttttttttttttttttgagacggagtttcgctcttgtttcccagtctggagtgcagtggtgcgatctcggctcaccacaacctccacctcccagataaagcaattctcctgcctcagcctctcgagtagctgggattataggcatgcgccagcacacccagctaattttgtatttttagtagagacggggtttctccatgttggtcagactggtctcgaactcccaaccgtgggtgatccgcccgcctcagcctcccaaagtgctgggattacaggtgtgagccactgcgcccagccagctatgcttctttttctctcctttcttcctgagatccagagtgttcctgatctttttgcttgtggagaggagtgggaaatctcatggagctcaccaaacttctctttgggctcttgccaccctaggggctctgatgattggtcatctattctgtgtctccaggacctagcagtttgtttgtctcataatacaaactcaggaatgtttgttgaataatgaagttcatagggcatagttcctgccctgtaaagtgcttagcagccttgtgtttatattagccatttaaaaatcttgtttgtgacttgagtttgaaacatttttgttgactcttgaactctttcttctgaggaaaactattgatttttgaacatttaagttgtacctgattatcatttcaaactctcttatcagtttaggaaaaattgactcaagaagaggtaggaggccgggtgtggtggctcatgcctgtaatcccagcactttgggaggctgaggcgggcggatcacgaggtcaagagattgagaccatcctggccaacatgctgaaaccccgtctctattaaaaatataaaaattagctgggtgtggtggcgggcgcctgtagtcctagctactcaggaggctgaggcaggagaatcgcttaaacctgggagtcagaggttgcagtgagctgagaacacgccactgcactccagtctgggcgacagagcgagatgccatctcaaaaaaaaagaagaggtaggaaacttgatcagactagtaaccatagaagtgatgggaaaggtagataaagaactaccttctgagaaggccctcagagtaggtggtttcatagaaaatgaaataaagcattttagtttgttgtatgagattatcatagcctaatactgaaactgggcaggaagggcataatacaagaacacttggacagatctcatttataagaggtacaattcttgtcaataaaatcctggaacaccaagtagagacttattaaatgaatgatgcatgaaaccaaatatgatttattctagcagagtaatgataacttaaatttaagaaatctatcagttcattatatttacagaataaaagagtccgggcacagtggctcacgcctataatcccagcactttgagaagctgaggtgggtagatcacttgaggtcaggagtttgagaccagcctggccaacatgatgaaacccgtctctactaaaaatacaaaaaattagccaggcgtggtggcgtgtacctgtagtcccagctactggggaggctgaggtgggagaatcacttgaacccgggaggcagaggttgcagtgagccaagatcacaccactgcactccagcctgggcaacagcatgagacttcatctcaaaaaaacaaataaaataagataaaataaaagagaaaacttttataatcttcttgacaaaggctgaaaattctaaaaatttattattacctgttttttagatgggggtctcactctgtccccagagtagagtgcagtggcacaattatagttcactgcagctttgaactctttggctcaagtgatcttcctgcctcagtcttctgagtagctgggacaacaggcacacaccactactcatagcaaattttttttttaactttttttttttagagatggggtcttgctgtcttgttcaggctggtctcaaactcctggcttcaaagtgatactctcatcttggcctcccaaagtgctgggattatagacatgagccactatgcccagccaatattcttattttcctcttctataacacaaaaggtatcataagatatgcactattctgtagcttgttttttaaaaacttaatgtgtcatggaagtctttctgtatcagttcatagagtgtgtcttcattctttcttgtggctacataatatgccattttgtgggtgtgccatagcagcacataaacataatattcatgaagctatcggttgatatctttaaaaaagttttttaaacttttaatttgccgggcgcagtggctcacgcctgtaatcgcagcactttgggaggccgaggcgggcggatcacgaggtcaggagatcgagaccatcctggctaacacggtgaaaccccatttctactaaaaatacaaaaaattagccgggcaaggtggcaggtgcctgtagtcccagctactcgggaggctgaggcgggagaatggcgtgaacccccggcggggcagagcctgcagtgagccgagatcacaccactgcactccagcctgggtgacagggagactccgtctcaaaaaaaaaaaaaaaaacttttaatttaaaagtatttattttttggctgggtgcagtggctcacacctgtaatcctagcactttcagaggccaaggccagcgatcgcttgagcccaggaatttgagaccagcctgagcaacatggcaaaaccccgtttctacaaaaaataccaaaaaagtatcttagccgagcatggtggcgtgagcctgtagtcccagctactcaggaggctgaggtggatcacctgagcctggtaggttgaggctgcagtgagtggagattgcaccactgtaccccatcctgggtgacacagtaagaccctgtctcaaaaacaaaacaagaaacaaaaacaaaaacaaaaaaaacacaaaaccccaaaaagtacttattttttacttatacaagtaatatttaactaaatttttaaaaaaattcacactaaagcaaaaatctcttggttattcctaatccctatctcctcctaagagctaatttttgttattagtttgattatctgcccctttctggccagtattcccgctggttggaaatgtaactcccagctgcaatgttagtttggaaactagagtctcatcagtggctcttagttacacagggaagctagaaattctctcttccttttctgcctgtacaaattccattcacatctcttttgttaactctgtctcatcatcttcagcctgctttatggttgtccatatatttaggttgaaccagataaaattgctattttggtaggtaaaaagcagttgattatcagcaattaaatgtggttcaacctaatagttttaaagcctaatccatttatgtgtctagttctcctcaagggcaggggccagaacacatgtttgtataatcccttccaagacttagaattggctggtcagatcaaaagcacttaataaattcctgttgactgatgaagctaagctgtcgccaaggcaggcagagttgtgatccactaaatcttaccaggttgatctctaagatggtttttgcagcctccctcttctctgaaatgtaattgggtccccaccgccgtaagtgacttgcatctttgtcacactttagggaagtggggaggaccacttaatctttggaaaattttgcgccttggctactattgagcctcttggaggggtttgtttaggtctgcagagagttggatatgtgtgcccaataaagttttttttgaatgagggagaagctttacattagctgaggacgtaaagacccttcagagtgagtggagttgctggcctaggagttcacacttgattctatgaatcctgacttccgaccagtgcatatccaaaagaatttaaggttttccctgaggttgccaacttttaattttgccaaataaggacatttaaaataagtatgtaattatgtacttttaatagttaatatgtgctcatggtacagcattcaaaatgtccaaaaggatatacagcaaataaaatgagtctcatgcttcctctccagttgcttaaaactatccagttccccttccgggaggcaaaccgggttacttgatcctccttcccgaggtagcccacgcatttaaaaacaggtatgactgtactggctctctcccttcccccacataaatggtagtgcattcaaatactgtttgacatctttgagtttacctcccacatttcttagaaatcttttaaaatcaatacattaaaaaaataaagtaaaatcaatacatagagctgccttattctttttgaaggctgtgtgatattaggaagggtattaaaaacagttgttatcgttttaacttagaaggtatatttaaatactaaaagttagaaagaatgcgatttcaagcgggacgtggtggttcatgcctgtaatctcagcactttgggaggctgacgcaggaggatacttgagcccaggtgttcaagaccagcctgggcaacatagtgagactccacctctacaaaaaaaaaaacccaataaattagctgggcatggtggtatgagcctgtagtcccagctactctggtggctgacgtgggaggatcacttgaggtcaggagttcaaagctgtagtgtgccatggtggtgccactgcactccagcctgggaaacagagcgagaccctgtctcaaaaaaaaaaaaaaaaagtgatttccgtgtaaagaaaatttcctgccttagtccaaggaccctgtgtgagaaagctgttgctagagatagtaaaccattaaagaaagtggtttgaagccaggagcagtggctcacacctgtagtaccagcactttgggaggccgaggggggcggatcacgagatcaggagatcgagaccatcctggctaacatggtgaaacctcgtgtctactaaaaatacaaaaaaattagccgggcgtggtggcgggcgcctgtagtcccagctacttgggaggctgaggcaggagaatggcatgaacccaggaggcggagcttgcagtgagctaagatcgtgccactgcactccatcctgggtgacagaacgagattccatctcaaaaaaaaaaaaaaaaaaaaagaaagtggtttgaataggaatgtgttaagacagattgtgttattttagagaggtttactagcctcaggtaggctgaatgaatgagagggtaagagatatataattgccatattgatgtccttctccccattttacagagaggagtggatttagggaatcctctcttgtctcctacaattgtactatttcatttgtcagatcagacaattagccagtctgttgtcaagatatcttgtatttatagcagctgtcatttggattggagtaggaagactagtttcagggctgtttatgtcttttgttaatatttttgagcaagtaaggtatgcatagtagcaattaggaattatggaaaacatacccttccagtcctctgtgaggaatacacacatgaagtgatgggggcctgaacttgaggagtgaaattggaataggttgctggagtctgagaatgttggaatttaaaaactgacagaatacatgacctttgggaagaataagaggagtggaattcatttgctaaacatttattgagtacctagtatgtgcaaagtactgcaataagttaatgccaagcaaactgccttagagggtgctagtgtgggttgaaaagtacacagtatacagacacaagaaagcaggcctgttcatttaggtaggtagcatgtgtttattaggacagcactgtactaggtgctggatataagaaaggaaggaagtggtacaaaccaggttgcagggagaaaatacagatagaatgtaaactttttcagtctagaatagctatttgattaatacaagtgttttcagagaaaaactgcatacaatatttttctttatttttaaccgtttattttttggaatgagcaatacctttatatagttgaaataaaaaggtattataaggtatactgcaaaaagtctccctcctatttttgccccttcccacctcttatccagatacctctcttgtgtcaggaataaatgctggaaacagaaaccagcccgagtattttaaccacaaaaggatttaacgtggggaattgggtacttttaaagttgttggaagggctggaagagtgggactcaaggaggctgcccttagggtatcatcttgaaaggcccacaatcgtagctgtgatctggtcaggaagtcactactggcactgccatctgcaccactgctgcttgacatgcatgaaactgatgattagacattaggctctggcttattgcagaccagcagcagcagcagcagcagcaacatctgggagcttgtgagagctcttaggccccagcttggcatactgaatcagaatcttcatttcaacaggataccttgatgatttacatgtgtgtggaagcttgataggccttgtactggacctggccactaacccaagggtctttatgaccttggccaccaattgtaaggaagtcagggaaatgtagttgttgattttcctaactctcagtctagaaagaaggttgaatggaggttgaaagaaaccatctactgaactgaccacacttttccacaagtaacctttgttgtttcttgggcatccttccagatactttatgcatatataagcatatgtgaatacatatccttttttctcctctttaaaaagtaagtcaggtgtggtagctcatgcctgtaattccagcatttggggaggctgagccaggatctgctatcctgggcagatagcttgagcccaggagtttgagaccagcctgggcaacgtaacagaactccatctctacaaaaaatacaaaaattagcactgtatggtggtgtgtgcctgtagtctcaactacttgggaggctgaggctggagggacacgagctggggagagggaggttgcagtgagccgagatcacgccactgtacttcggcctgggtgacagagtgagaccctgtctcaatcaatcaatcaatcaatcaaaataaaacgaaacaatagcttagcatatacagtgttctgaatcatataactgtatatcttagaagagctttccatatcttgacagataaaatcatcttgttctttttaataaccgcgtagtataaggctgggcacggtggctcatgcctgtaatgctagcactttgggaggctgaggtgggcggatcatgaggtcaagagatcgagaccatcctggccaacatggtgaaatcccgtttctactaaaaatacaaaaattagctgggtgtggtggcacgtacctgtagtcccagatactcaggaagctgaggcaggagaatcacttgaatcagggaggtggaggttgcagagagctgagatcgcgccactgccctccagcatagcgacagagcgagaccctgtctcaaaaaaacaaacaaacaacaaccaaaaaaactgcacagtattccattatattgcttataaatgcttaaaattgagactgtctgatacagtctgggttgcatggtcattctgatttattggcacatgtaaaatctaatctagttgttaaatccttaatgttttcttcctgcctcttgtgtgctcaagtcttctgtgtatgtcatcttgtttaatccacactacaacccagtgtgcttcttccactttacatgagggaactcaggctctgaaagtttaatttaatggttcataaactggccgggcacagtggttcacccttgtaatctcagcactctgggaggttgaggcgggcagatcacctaaggtcgggagttcgagaccagcctggccaacatggcgaaaccccatctctactaaaaatacaaaaattagctgggcatggtggcgggcgctgtaatccccgctactcgggaggctgaggcagggagaattgcttgaacccaggaggttgcggtgagccaagatcacaccactgcactccagcctgggtgacagagcgagactctgtctcaaaaataaaataaaataaaatagttcataaactaaggaatatgcaggttaggatttggacctcaagtctgttaccctccataatttgtgatttgacccaactacacagagtctctaaacggtaggcctggtaaccttctcctttgggaagaggtttggaaatgtaccattatggatatttggatatttggggtgggtattaaaggaatgccaatttttttttttctgactcaggtatccagctcacatagaagacattgactacgaggaaggaaaagtactcatccatttcaagcgttggaaccatcgttatgatgagtggttctgctgggacagtccttatttacgccctttagagaaaatacagctgaggaaagagggcttgcatgaagaggatggatcttctgtgagtaacaaatctgggaagttctgtagtatgcaaggtcagccattgggctgtttgtgtttcaatctttgatgttagtagcagctggagaccagttcttatttaggcctatagttgtaaccctgagatctctatgacacctggggctcttgaagaatcccaattttgtttgtttgttttttgagacggagtctcgctgtgttgcccaggctggagtgcagtggtgcagtctctgctcactgcagtctccacctctcgggttcaagcgattctcgtgcctcagcctccctagtagctgggattacaggtgcccaccctggctaatttttgtatttttagtagagatggggttttgccatcttggccaggctggtctcaaactcctgaccaattttacggcattgtatccctaacttctagaacactgcctggcacattgtagatcttctgatcttttgttaagctgtctggtcttttgttaagtgatcattctggccaggcgtggtggctcacacctgtaatcccagcactttgggaggcggagacaggcaaatcacaagatcgggagtttgagaccagcctggccaacatggtgaaaccccacctctactaaaaatacaaaaaattagctggatatagtggcgggcgcctgtaataccagctactcgggaggctgaggcaggagaatcgcttgaacccaggaggcggaggttgcagtgagccaagatgatcatgccactccactccagcccgggtgacagagtgatattccatctcaaaaaaaaaaaaaaaaaaaaaagtgatcattccatgtagaacgttgtactaagtctcatatgcaaggtcttcttcttttgagacagggtcttgctctgttgcccagacgggaatgcagtggtgcaatcatggctcactgcagcctcaatctcccaggctcaagcgatctttccacttcaacttcccaagtagctgggaccacgggcccaccacacccggctaatttttaaatttttttatagagacagtgtctcgtattgttgcccaggctggtcttgaactccgggctcaagtgatcctcccgccttggtctcccacagtgctaggattataggtgtaagctcgtcctgcagagtcttttataagcccttaaagaacttggaattgattggactgtattccatttttctaaattttatctctatgcctggagcttttactgacttcaaaatgcagtatgaagtattagttttaaggtttttttgttttgttttgttttaagcagtgaaagcacagatttattgaaatgaaagtacactccacagagtgggagcgggctcaagcaagtagctcaagagccgtttttttggtttgtttttgagacggggtcttgctctgttgctcaggctggagtgcagtggctcgatctcacctcactgcaacctccatctcctgggttcaagcgattcccctgccttatcctcctgagtagctgggactacaggtgcgtgccaccacacctggctaattttttgtatttttagtacagatggggtttcactgtgttagccatgatggtctcgatttcctgacctcgtgatccgcctgcctcggcctctcaaagtcctggcattacaggtgtgagccaccgcgcccagccggttttttttttttggttttttttttttttgataatgttgtccagctttatttttgctttcttgccaaagatttgtcaagctcctcactctgtcattataaaattcccaccctgagaatctcccatttttcttcaccatcaccacacacacacacacacacacacacacacacacacacacacacacacaggctgaaacaataaaatataaagttcatcctaagaagaagatatcgagtccaaagagggttatcaactttagaaaagaagcaaagaaatcataaaataatgatattttaagattacagattaagccctaatttagaatatttttagaaattttatcatattaaaacaagggtgaaggcactatagactcttgttttttaactaactttatttaaattagctatacccattttaagtgtatgatttcataagttttgtgtaataagcttaaatttaataagcatttaaatttgtgatataaaaatcacccattttaaactgtatagtttaataagttttgcaaatttatattgtcagatagccactgccatatgatacacaatattttcattatgacaaaaagaagctctccctcaaattgcttttcattcagtcttcaccagccagtcctggaccagttctggaccctggcttgccactgatctatctattttctgtttatagtcctatttttgtttggtttttcatttgaaataaaatcatactgtatgtaacatttcgggtctgacttacttcaattagcatatcttttgaagcttcatttatggtgttttttttttctgttcctgtaataacagtttgttttatttttttaattttatttattaatttttttattatactttaagttctagggtacatgtgcacaatgtgcaggtttgttacatatgtatacgtgtgccatgttggtgtgctgcacccattaactcatctttttttgtttttttttaaagagacgttttcttgctctgtcgcccagtctgaagtgcagtggtgcagtcttggcttaatgtagccttgacctcttgggctcaagcaatcctccttcctcagcctcctgagtacctgggactataggcatgtaccactgtgcctgactaattaaaaaattttttttgtagagacaaggtcttattatgttgcccaggctggtcttgaactcctggccttaagggatctttctgccaaagaaggaagatccttcgtacctcccaaagtcctgggattataggcgtgtgcccttgtgcctggctagttttaaggtttttaaacaggcattgagacatctataatggtcctgctgcttttggatctgactcagactcagccctgccttctatttttctttctttttttttttttttttgaggcagtcttactgtatggccgaggctggagtgcagtggcatgatcttgactcactgcaacctgtctttcgggttcaagtgattctcgagtcttagctttctgagtagcttggactacagacgcatccaaccacacctggctaatgtttgtatttttagtagaggtgggagttcatcatgttggccagactcctggcctcaggtgatccaccttccccagcctcccaaagtgctgggattacaggcacgagccactgtgtccggcttattttctgttttaaccctattagggaacttgaactattgctggccttttttttctttttcccaattaaggattattcagtattgttccatttgacttttcagtgttcattctacaaatttttttttttttttgagacagagtctcactgtatcacccagcctggagtgcaatggcgcaatctcggctcactgcaacctccacctcctgggttcaagtgattctcctgcctcagccatcgagaagctgggattacaggtggccgccaccacacaggctaatttttgtatttttagtagagacggggtttcaccatgttggccaggctgatctcaggtgatctgcccaccttgacctcccagagtgctgggattacaggtgtgagccactgcacctggcccattgtacaaaatttatcagtgcaaactgtgtgctgggaaaagagtataaaatattaaaggtgaatggttgctttccctggcaaaagaccctttagaagtgtagatggcattaaatgctgcttccctgagtatgaagtagcctcatatcttctgactcctatactggatgtgtattctagtagtcctggcctcttagactcattttcagaatgtatgctggttagggtggaattatcatcagtgctgttctgtgcctgcccagacctcttgggcttattgaggtcttgtgtcccagcccttttgttttgactcctgtcttagtcttttctgtgttgctataatagaatacctgagactaggtaatttataaagaaaagaggtttgtttagctcacaattctgcaggctgggaagttcaagtgcatggtactggcttctggcatcagctttcatgctgtgtcatacatggtggaaggtcaaaaagggagacaagtgtgaagagagggaccaaacagaaggagacttgctttgtaacaacttgctttcttgggaatgaatccattcccaggagagcgagaagtcactcctgtgagacagcattaatctattcatgagggatctgctaccatgacccaaacacctctcataggccccattttcaacactgctgcactgaaaacgtttacttttggtgaggacaaatgacaccgaaattatagcaactcctagtgttgaacaacagaaatatcttcctccatctcaacagctactttcccttcacactttcttatcaatcccagcttcttttatgagatctggtatgtcctgtatgtcctgtgaaattaggttggtaacaggatcttttttttttttttatgttttttaggaatttcaaataaatgagcaggtccttgcttgctggtctgattgtcgtttttacccggccaaagtcactgctgttaacaaggatggtaaggcatttgagttgtagttgtttttactcatgacttaggtggtggggggggatgtttgtaatatcagagcttgatagtatattttcagtatttatttactgcctaggtatccgctttattcaagttaatcactatgtcaggagttgggtagaaattataagtgtaaagaaaactggacaaaaaagatagtttgactttttaccccctgaatttcagtcattgttttctaaaacagtcacagttcatctgtcactctgcctggaagtatgcaggtacttgctgtctaggagttcctaatataattgatgacatagtcctgaatatttgtgaatagcttagaaattaaatgaacactaacaaactttaaaaaatgtgctttctagatgcaaggtgactgagggtggtctgtaacattggagttgctagtggaaactgggatgccggaatttagagcactgagttgggtttcatttgccagagttgaacatgtgaagagacaggatggggaacttgactaatagaggctcaattttgctagtaaaagggcagacaaagagttatgaggataatatgtacggtcaggatcctggcacctggagaatagagtctgggtcccagtgataccattgtaagcacattccactagggtgtgtgtggtctccatgatctctgaagtgagtgtttagggaagtcaggcctcttgatgccactgtagggttgactattaggccagcctgacttttcatttgatgaagttattcagatatttattaatactctgctaactgctgggcctcaggctgaccaagttttgtctgagaatgattttttttttcttgttcttttttgggacagagtcttgctctgttgcccaggctggagtgcagtggtgccagctcagctcactgcaacctccatctcctgagttcaagcgattctcctgcctcagcctcccgagtagctgggattaccaacgtgcaccacggtcagctaaattttgtatttttagtagagacggggtttcgctatgttggccaggctggtctcatgtgatccacccacctcggcctcccaaagttttgggattataagcgtgagccaccatgcccagccgcaactttttagaaaagtatttttcaggccaaacacgatggttcttgcctgtaatcccagcagtttgggaggctctcgtgggaggatcacttgaggccaggaatttgagaccagcctgggcaacatagtgagacctcatctcactatgaaaaaaaaattagatgagtgtggtgacatgttcctgtagtcctagctactcgcatggctgaggtgggaagatcccttgagcccaggagtttgaggctacagcaagctatgatagtgtcattgtactccagcctgggcagcagaacgagactctgtctcttaaaaaaaaaaaaaaaaagtcttttcagttgtgcttcctccataagctaaaattataggagggagagtctcgaggctatgatagttcctaaaatggtcatttgcaacgctaatatcttgtttctgaagctccatattctgtccagtgaaatttagttaattgaaggacatgaaaatgaatggaaatttctgccaaaacctgttgtcctgaggttcttgggtctgaagtcctgtattatgctgacacattgactggtttttgggactaactggaagagggaggagaggatatgggagaggggcaatcctgaaacagaaagttagtggggcaggctgggtagtactattggccacccagattgtgaaggaaagctagcctttgtaggagctcagatctatgtctgattcagagatgaagataattaatgcctctaagaggggtgggaaggtgtcttggtggaggcaatgaaggcttagtaatctactgtttagatctaatacctgcagagcccagagcttggcatcatgaagtaaaacaaaagaagacctgcttcaaagtagaatgaagtaggtgctgaaatagagctaccaggaggaggcagggcaggatggtgcaggttaatcatggtaggcacctgtctctataaggttttgtgtttgtgtgtgggatggatcagaaactctttgaaataatgatttcaaaaatgattaggtttggattagagctgatggtcagtttgtgcttcatcacgattcactgtgggattacttgtgggattgggagcgacaatgctagtctctcttttcactctttccttggtattttctgctgtgcctcaggttcattcgtagcagtggccaccagcttaatggccctgcgaggagaagctctgccggcaaggcggcccctttatttcctgtaaatgtcacttatgtcttgttggtgctgccaggaggaggcaggggatatagtgaagtcatgccttgtagatttatctttagaaggcttggtctgattttcttgccactcttaatctccttggatgttttgctaaagctgagtgttgagcaggctggtgggtggggactgtagccagagtgtggaagtggcagctgctggcactgaggagtctggcatgattgaatcagaactaaataacaactttagtttcttaaggaagtctgttagcactcggaaaatagggcatataatgccatattatttagcttttttcacctggagtggttcttcagcagtggagattaagcattatttagtacgaaggcagcggcagttggtagccttgttagaccctcagtctgtgttgttacaaaagacagtaaaagatgggtttctactttcagggaatctttgtttggaagccatctctggtgagctgacctcacctctttgctggggctgcttagcttccccctccgtttttttttttttttttttttttttttttggtgacagaatcttgctctgttgtccaggctggagtgcagtggcacaatctctgctcactgcaacctccacctcctgggttcaagcaattctcctgcctcagcctcctgagcagctgggactacaggcacatgccacaccacacctggctaatttatatatatatatatatttttaaggtttcaaatgtactttatttcttcattaatgccatatcttaatgggtacacagtgctttaacttggcatcaattatgagctgtttttttttttttttttttttttttttttgagacggagtctctatgagctgttttttaaacaattcattattacatcagctggtatgattactgttctctccattttggggggtgactctgccaacaggggatgggttccattctattccaatttgtgttgttatatatgtccacatagcaatacagaaagtgggtccactagctaatacagtattaccatatttgttatgaaaatcaggtgtatgtttctggtggctctgccttgccattgtttgctgaatgcttcgaacttggagatgactgagtttgtttttgaccaagggaaacatcgtgaaggtgaagatagaactgcagcaatgaagctgctgctttaatttttgcatttgtaggagagacagagtttcactgtattggccaggctggtctggaactcctgacctcaaatgatccacccgcctcagcctcccgaatctcccctttttttcacacaaggattagcagagtcagttgtctgtcagggctttttgcccccagtagtgtacaactctgctctgtaagtgattttctttaaggaaactactgtgtaggttagcatttatgacaaaatggggaattggtcctttctgttgatctgtggttctttaacttgaatgagcaggtaaatcagctccttcttcctaaaaaatatgcatatttttgggtcatgtcccctacctaccctgccagttcagtctctggggcagtgactgaagtctgcatttataacaggagatgctatggaaatgatcttgtttctagagtctctggctgaagcagctcttattttttgttttcttcatgctgtaactgattctacatttgaaatgtggggaggctgatactgtgtgaacagctttgtagaaagagaaaaggaagatttaggcccacacgtgcaggtgctagcttggctgttttcttctattgggggaagagggattgtgcttcccccccaacccccaccccgcccctttttttttgcctagatagcctttaacgatgtcaatgtctggccaggcgcagtggcttatgcctgtaatcccagcactttgaggggccggggcagcggattacctgaggtcaggagttcaagaccagcctggccagcatggtgaaacctagtatctactaaaaatagaaaaattaacctggcgtggtagcatgtgcctgtagtcccagctactcgggaggctgagacagaagaatcgcttgaactcaggaggcagaagttgcagtgagctgagattgcaccatactgcactctagcctgggtgacagagcgagactccgtctccaaaaaaaaaaaaaagatgtcaatgtgctgtgcttcccttttagggtgacttggtggtattgatcccttggtctgtgacaggccctgtgctaggttgtttccatatcttatcgtatttagtctttacacaaacatggaaaggttattgccattaaccccattcttattttgcagatgaggaactaagctcacagggggaaactgcttgaggttataaagcgcttggatggtagagctgagatctgcatggaggtctgtggttctacagagtccctaaactgtcgttcccacagtaccaggctgcctctttggagcagggttttcctaagagggcaggtgttgtcaattaggtccaggtgttcactgatagaatgcgagagtggatgtagtggtctgcactttctggagccggtgttgtcttgagaaccatggttgggagacagggtctggtcccagctcctgctcagtgattatgggcggttcactgcctttgctctggactcttttgagcagttagaagtcaaagagggagtgggaatagatgagtgttgtattggccacagaacctaaacccaaaatgtaaaattgctaagaagaaaatacttagagggaggggaaggcatgcccacaaacatatgcacatccccacccctcaatctgtggaagcctaaggacttcaagaaaacttttttttttttttgagacggagtctccctctgttgcccatgctggagtgcagtggctcgatctcagctcactgcaacctccgcctcctgggttcaagtgattctcctgtgtcagcctcccgagtagctgggattacaggtgtgtgccaccacgcctggctaatatttgcatttttagtagagacggggtttcaccgtgttggttaggctggtcttgaactcctgacctcatgatccacccgcgtcggtctcccaaagtattggaattacaggcgtgagccaccgtgcccgacctgactaatctttttttcctttttttttttttctaaaaagggccagtccaggcgtggtggctgacgcctgtaatcccagcacttttggaggtcgaggcaggtggatcacctgaggtcaggagttcaagaccagcctgtccaacatggtgaaacccgtctctactaaaaatacaaaaagtagctgggcttggtggcgcgcacctgtaatctcagctactcgggaggctgaggcaggagaatcacttgaatccaggaggcggaggttgcagtgagccaaggtcgagccactgcactccagcctgggcaacagagcaagactcgtctcaaaaaaaaaaaaaaaagaaagaaaaaaaaagaaaagactagttgaaagcagttgtgagaagaaaggaaagagtagaacaacaagttcgatctgtaactaactgtgaaccatcaattgagataactcactactttcagaccagcctgagaaaacatgtttgaaaaccctccgttttccatctgtggcattctggaataatctgacttccgaagagtgaatgagatagaaaagaagccctggacgctgggcaggatggcacacatctgtaattccagtgcttttggaagttgaggaggcaggattgtttgaggctgggagtttgagaccagcctgggtaacatagaccccaatgccccgctatctctacaaaaaactaaaaaataaaaaattggctggacatgttggtgcatgcctgtagtcccagccacttgtgaggcagagacagtaggattgcttgagcccaggagtttgaggctgcagtgagctaggttcgtaccactacactccaggatgggtgacgaagaccctatttctttctttttttttttttttgagatggagtcttgctctgttgcccaggctggagtgcagtggcgcgatgtcagatcactacaacctctgcctcccaggttcgagtgattcttctgcctcagcctcccgagtagctgggattacaggcactcaccatcatgcccagctaatttttgtatttttgtagagatggggtttcaccacattggccagactggtcttgaactcctgacctcaagtgatccgcccgcctccacctcccaaagtgctgggattacaggcgtgagccaccatgcccggccgatgaagaccctgtttctaagaaaaaaagaggccctggaatattggctgtggtagatttcatgagcaacagaaatctgtccaatccaaaatcacccatgtattatccctatgtctttggtcctagagaacatgagcttgttatgcatctcagttttgttcttagaacccttttagtgttactgactgctataagattgtctgcaatgctgagtccttaaccctcagaggggcaagaccaggaatctttgtttcatcttaaagtctaaggacaaaaactccttgagggagtctgaggcaggtagcccttctgtcacgttagaggagatggaacaggatacacttattttgagttccttcatttacatgttgtttgttaggtagtgtttgtggccacaggagaactctattattagctacctacgggaggattccatgtgaagacaatcttttagtaatatacatgaaaccatctgagtaaaatgtgggcctctctgttgtccattattctgtctgatttattgaagcccaagttaggctgtgtttagcatgaaagtttcaagatgatcctttgtagtcctttggaagttaaaaggatcaaagaccgagatatatctaaggacggtcatcccttagcacctttggccatagtttgggtcatttcagcactctgaaatgggtctgtggtttggaattagactgaggagcttgagcaataggcagtgcggggtggtgggaaaaaattggttggaggtcagtagacaggcttggattccaaagatagctgtctcagacttaatcatggaactcaggttccttttatgtaagtcctccttctggaatctgccatcaggagtaagcttcaaaattaactccaagtagctgaaaatgttggactgttaggtaacattactcaatattgacttttggatgttggaaatgcctgtaaaaatggcagttttcattttgatgtaactgatcctgaactaactttgttgataaaatagttgaaagtagagtcttgggtggtttgttggcacacataatatttaagatttcaagataactggagtcttaaaactcccatccccccatctccgtccccagacttgccagagttgcaccatggttgcttgagagggttctgtttagaattccatagcattgtttatcataactgctttgcttgccaacaccctgacaatataggcaggtaaaaacaggaacccagacctttgttgtaagtactcataagtcattgctgagctgcctgtgtagataattgtttatgctcttatccttttatgttcttatccttttatcatagcctgttcatctaattgttgttgtcatctaattgctgatgttttaacccaaccaggcataactatgtatctttatatcttgtttgctagccagtttcttttttttatatttttaatttttttaaaaatttttaatttttgtgggtacataagtgggtgtatgtatttatgagttacatgagatatcttgatacaggtatgcaatgtgtaataatcacatcagggtaaatgggggtatatatcacgccaagcatttatcctttgttacaaacaatccaattatgtagttattttatttttattttttattttttttaggcagagtttcattctgtcacccagtctggagtgcagtggtgtgatcttggctcactgcaacctccacttcctgggttcaggcgattctcttgcctcagcctcctgagtagctgggattgcaggtgcccaccaccatacctggctaatgttttttgcattttttcagtagagacagggtttcaccatgttggccagacaggtcttgaactcctgacctcaagtgattcacccgcctcggtctcccaaagtgctgggattacaggcgtgagccatcacacctggccaagttattttaaaatgtacaattatttttgactatagtcaccctgttgtgctagcaaatactagatcttactcattctttctaacttttttgtaccccttaaccatcgacacgttcccccacccctgcctactacccttcctagcctctggtaaccctccctctactctctatctccgtaagttcaattgttttaatttttagctcctacaaataggtgagaacatcaaagtttgtctatgtcttgctagctagtttcgtcatgtattggtgacacctgtgacaaataatcacctttattttgtaattaccaggaataaaggtcagtaggtaattactaattgtctatggcagtggttcttggactttggtgtacatcagaatcacctggaggagttgttaaaaatgcacattcctgtgccctgttcccagttgctgtttcagtgtatctgaggtgggactggtaacttgcatttctaatgagttcccaggagttgctcatgctgctgctgtgggaccacactttgagaagcactggtttactctgaggcaggtactgtgtgtggaagaaagtggtataagttatggtctctggccttgaagagcctgcttttgagttgtgatctgtacttatatgaaggtagacctaagtttgaagctctgtaggctggtgccaaatgagcctaagaagttcagatcgggggtaatcattagtagctgaaaagcccggaagcttttacagaactgttgtgggtatttgagccaggcacttaaagatcagtgagtggcacattcccagaaggaaaacacttttaatacagatgtggagttagaagtgtcgctggcagtttcagtgggtagcttgtcactttgagttggtgggtattggatggtggtaatgggaaataaggtttggaaaattattggggtcagattgtgttggaggttgaatacttttggacttcatttggtacccgtgattagccattgactaggccctgttgaggactggcggtggaggggtgtgggaagagaatgtatcagaaggagaaaaccaggtcttaactttgttgttgcattcttcggctcccaggcctcagggttttttgcagggggtgggggaattggttctaaaaagagaaaaacctgtttactagtggaaaccattacgtgattaccaatggtttactgaatcttgacaagattaattgtgattattttaaatccctggggcaaaaatgggtggggcatgaattggctctaagatgcaaaatttgaaagtgttgtttgggtacaactaatgagaacttctgtagttggacaccttatttgggaagataagattatctgggtttccagcttaaggtttttagcagggacggatctttattgaataatttttttctaatgggaaaaaactaacagtgtagcagaaaaaaactaacaatgtagcagcaaacattttgtgttttgaccaagtctctattttagaacattgtatcatgaacataattcaaatggattttgagttgtggaaatagaacacatctcttgaaacacaatacctttagctgaatgatgttccttttttttttttttttttttttttgttttttttttggagaaggagtcttgctctgttgcctagcctggagtggagtgcgatggcaggatcttggctcactgcaacctccgcctcctcagttcaagtgattctcctgcctcagcctcccgagtagctgggattacaggtgcctgccaccaagcgcggctaattttttgtatttttagtagagacaggtttcactatgttggccaggctggtctcgaactcctgaccttgtcatccgcctgcctcggcctcccaaagtgctgggattacaggcgtgagccatgatgttccttttaaaacttgagagctattactgcccccgatcccggaacgtaaagattaaattataaaagtgaaaaattcaccaaggaataaataagtctgcattttactcactttcttaattgttttactgctctttgttcttcacttaaattcagtgaaattttttttattttaatgaagcatctaaaaacaagtttatttttttgatggatttcaatttacgtaggtagaaaactaatcttaactaagaaatgaagataagcatactgttatcttggacataagtaagactgaatatgattcttaaacagttttaaactcctataagcttattatgtggttggagatcccttgtgtttatactttgaaaagttaccacttttcatgaaattgtgagttaaaatcatgatatcttcttgaattttaggtacttacactgtgaaattttatgatggagtagttcagactgtcaaacatattcatgtcaaagctttttccaaagatcaggtgagaaatgtggttttgtgctttgtgttatgaataatgctaacattgtagttttgtttcctcaaataaagacattacatttgtttatgatagcaagtgtttatttcctccatctgacacaatttcaccagaaaataatacacaagttttcagaagttgtaaatatttgtctctttgctgtttcctatttatttatttgtttatttagaaacagagtcccgctctgtcgcccaggctggagtacaatggtgcgatcttggctcactgcaacctctacctcctgggttcaagcaattctcctgtctcagcctcctgagttgctgggattataggcgcacgccaccatgcctggctaatttttttgtatttttagtagagacggggtttcaccgtattggtcaggctggtctcgaactcctgacctcaggtgatccacctgccttggcctcccaaggtgctgggattacaggtgtgagccactgtgtctggccactgtttccttttaacagagattttttttcaaaagtgccaaatgcttggataccattgcctatattctgttctcctaatcttttttcaacaatggttattcttttcttctctctgtgccctgcgccccacaagagctgttagccatacaggaaacttgttgaattgcttgaggagacctccagtatgttttctgtccatctagctctgtcttttagcttaggaccattacttggtggtttacagagctatcatttggcacagatttggcagccacttgtgctagatgtgcctggtttgtgattttggtatcctgttgttccagtcaccatgcatgtacttgcctgagcatggggcctcagttttggtactggaaatatggtttgcatagatacgggccatctagaagtgttgcctactttcttcatgatttttccccttttgtctttttcgtgtttatgttttaatagttgaggggaaaatagagatcaaaatttggatattagtctttttaaaaatcctgattattactaatttcagctgttgagacagctaatttagcaatttagtaaaagattttatcactgaggcatcataacttgctactcatctgcttggatagtagttgatgtgacaatatttggtgatgctataacctgttgtgtctttggtttttggtttttttttttttggagacagagtcttgttctgttgcctgggctggtgtgcagtggcgcaatcttggcccactgcaacttccccgcctccccagttcaagtgattctcctgcctcagcctcccaagtagctgagactaggcgcgtgccaccacgcccggctcattttttgtattttggtagagacagggtttcaccacgttgtccaggctggtctcaaactcctgagttcaggcaatctgcccacctcggcctcccaaaatgctaggattacaggcatgagccattgcgcctggccctctgttgtgtctttgtgatgatgaaatgattctacttatcagagatttttaatgaattcttctgtatgtatatttgtaagttgtgttttttttgagaccgagtctctgtctgtcacccagactgaagtgcagtggcccaatctctgctcagtgcaaactccgcctcccaagttaaagtgattctcgtctcagccttctgatttgctgggattacaggcatgtgccactacgcctggctaatttttgtatttttagtagacggggtttcaccatgttggccagggtggtcctgaactcctgacctcaagtgatccgcccaccttggactcctaaagtgctgggattacaggtgtgggccaccatgtctggcctattcataagtttctaagaaatttttttttttttttttttttgagatggagtctcactctgtagcctaggctggagtacagtgatgcaatctaggctcactgtaaactccacctcccgggttcaagcaattctccttcctcagcctcctgagtagccgggactacaggcatgcaccactatgcccagctaatttttgtatttttaatagagatgggggtttcaccatgttggccaggctggtcttgaagtcctgacctcgggtgatctgcctaccttggcctcccaaagtgctgagattacagggcatgagccaccatgcccagccgattcaaaggattttgatacatgatacctttagtggtaacctcaagaatgtttttgccttttgctggttttccttttcagaaaattaacaaaattattacataaagctttggccctgatgatgctttttctttgttcacttgtctctctggcatgtaaggagccatacagtactctaaaacattattttggccttaaatttggcaatttttgtgttaggtttgtagaacgagttaatatagaggacagaattataaacttgtccagaattggcaggttatatccagaaccttcccaagtggaagtccagggctctagataacaattgttcatctgtttactctgcgatactcagtaaattgatggatagcactcacagtgctttggcttggaggtgggtgccttacccagtgaggatttctgggtgccatgcttcatttctcatttcccaatggcctctgagtgtctgaccttagcccggtaggcccttaagcacaggcccaaggctcctggacttggcttcttttccaagagggtacagtggtttggctagagttatctgtcatgggcaatttcaaaggtttttcgtatactattggaatagattgagttttttttttttttctgtaggactgcactgccttataaatgttttgatagtctctatattagtaacacttatgtttttgaagttataatacgtttactgtagaaaaatatataagtacaaagcacaaagaaaataaaaactataattccatcaaacagatatcattgttcttaacgttttggtgtgtaacttgacttaacaatttgatgtatacatctttctgtgttttttattaaacgtacgtgtgtgtatttatttattttcaaaattggagttgtggtacattaatatagtactgctcttttaactaacatttccccatgttccttaatattctgagaatataatttttaacagctatgtagtattctgtaatatgtatgtaactactttgtgtaaccaattcccaaatggtcattaaggatatttgtaaatccaggtacacaagtctgattattattttagctaattttatttctaggaatttattctagttcaaaggtataacctttttagttttgactcaaattgccatctcctccctgaactcccaacaagaagggcaatttcagtttatatttctgctggctgttaccgagaatgcctgttctcaaacctggctgctttcagaatagtttgggggacttgaaaaaatatttccttgtttattatttttccctgtagaacaaattaaacttttatttgttgagtatttaggtactccttcctgcttccagtgaaaacctatgtgcctagtgtgtgctaggtgctgggcatcccatatgaacatagtatggtggtctctgctcttttgaggtcctagaagagagatatgtacacaaataaacttaattatagttttggaatctctagagctttcagacctggccttattatgaaacagtcacaatagaggaccctcgatttttagtgtgaattttaaagaatgtaatttagggagaacataactaagaagcggtatttcctaccaatagacaaaaactccaagtagctcaggaacatagtaggtggcttgttgaactgagcacagcctttacctgatagagaaagcagagaccctggttctgggttggataatctttatagttttcctgttaagcttccagttatcagtttttgtttttctatagacaagacatcagcatttgctggcaaactgaaccaggcctctgaaaagctctgggtcagtatagtcatgctggggataaggacagagcatgaaggcattttcttcgaacacctttgtcagaaagattgctttccagaattttaaggccaggcatggtgactcatgcctacaatcccaatactttaggaggctgaggcaggaggattgcttgagcccaggagtttgagaccagcctgggcaacatagggagaccctattgctacaaaaaataacaataaaaaacttagctgggtgtggtgaaacatgcctgtggtcccagctactcagaaggctgagatgggaggatcgcttgggcctgggaggtcgaggctgcatgagccatgattgtgccactgcattccagcctgggcaacagagagagactctgtctcagaaacaaaaacaaacaaaaacccagaattttattttctagtgacttattcgtcataataagggagattgcactgtctccggaataattgaattgttttaagtttaaggattggttctcaactcagtacaggtggctgttgtcagtggtgctttgtatatgtgatctggcgtatgtcttgttttaatttctttgtttgtcttcataagtttgtaagaaactcctaattttgtatttgcaagtaatcacgaagtgtttcatcgctattttgctcattttagaatattgtgggtaatgctaggcctaaagaaacagatcacaaaagtctttcatcatctcctgataaacgagagaagtttaaagaacagagaaaagcaacagtgaatgtgaagaaagacaaagaagataaacccttaaagacagaaaagcgacccaagcagcctgataaagaaggaaagttaatctgttctgaaaaggggaaagtgtcagagaaaagtcttcccaagaacgagaaggaagacaaggaaaacatttccgaaaatgacagagagtattctggagatgcccaagtggataagaaacctgaaaatgacattgtgaagagtccacaagaaaacttgagggaacccaaaagaaaacgaggcagacccccttccatagctcctactggtgagttttttaagtgggctctgcaatgggcaatgccagagtattcttctgtggccctttgtggttctttgtaacttgtgtacgtcaatcgtttatttttgtgactgattttgaattgtcttatgatctggaaacaagttgtgttcatgaagctgaatttaagtgaggtacatatccaagtgaatctaagttgggaagcatgttcataactgagtttgctaaagtagtggttaactgttgactagatacttcagcttatatgataaaacctgataaaccgaggccttttgcttatgctttttcaaatgatctcagtttaagtcagcttaatagaatctagaatcaggaaatagagttttaatgagacagacatgaaagaaaagtaatagtaaaaaggtatgggcttctgaaggagatggggacaaaggaacattgaaactagaaaagcatgggtgcattttgaaattgagctccttggagagtgattattgattagaaattttcacagtctaaataaaaagccgagatggctaattggtaagagtcaaggttagagggtatagatttagggaagaatgcagttattaaaaaacttaaaatttggaattcttctagaataaccaagaatgaaacaagccctgatttcttcctaagccaaacactcgttctccaaatcaattcaatggcatgaagaggcccccccggttctctggactgagcctgccattgattaatatgtgcagtgaccttcagacattcttgattgtgcattctttatgtgttcagttgaaaaactgtgaatcccctagcacgttttaaagcagtatttatctttttctcacaagtttaaatagctgcagtggatacatttaaaatacaaaacatgaaggctgagtgcgttggtgcatgtttgttgtcccagctactcaggaggctgaggtgggaggattgcttgagcccaagaattccaaaccagcctggacaatgtagtgacaccccatctcaaaacacacacacacacacacacacacacacacacacacacacacacaaatattttcatcaaaactgtggaactacagagcaaaccttttcattattccctaacgatgtagagaatgcaaagccagtcttccttatcaaatcagactatcagacttaatttctgtggaaaaaaatttaacttacttcacataagtgtattagtactcattgtaagataggaaattatataataggttgatttgtctctatatgaaataagggatctttccctgtagtgcttgtaactgggttttgccctcaagagctgagggtgctgcaattgtctgtaggcctaaatagggcctagacctctgctgtctagtatggtagccactagctgcatggggctattgactacttgaaatgtagctagtctgaattgagatatgctgtaagtgtaagtaaatgctagatttcaaatacttagttcaaaaaaagaatgtaacacacctcgattttaaaatactgattacggctgggcctgtaatctcagtggtttgggaggtccaggcgggtggattacttgaggttaggagtttgagaccagcctggccaacatggtgaaaccccgtctctactgaaaaaatataaagacaaattagccaggcttggtggtgggtgcctgtaatcccagctactcaggaggctgaggcaagagaattgcttgaaacccaggaggcggaggttgcagtgagctgagatcgggccactgcattccagcttgggcgacaaaacaaaaaaaaattgattccatgttgaaatgtttttagaggctgggtgcagtgcctcatccctgtaatcatgccagcactttgggaggctgatgagggaggatcacttgagtccagaagttcgagaccagccttggcaacatagtgagacctcatctctacaaaaaatgaaaaaattggctgagagtggtggcacgtgcttgtagtcccagcgattccagagtctgaggcaggaaggttgctgagcccagtttaaaaaaaaaattttttttaaagtactggattaaataaaatagtatttaaattaactttttaagttgtgtttttttttttttttttttttttttgacagggtctcactctgttacctaggctggagtgcagtggcgtgattgtggctcactccattctccacctcctaggctcaagcgatgctcctatctcagcctcctgagtagctgggactacaggcacatgccaccatgcccagctaatttatttcttgtagagacagggtttcactatgttgcccaggtttgtctcaatctctgggcctcaagcaagcaatcctgccttggcctctgaaagtgctgagattacaggcatgagccaccatgcctggcacttaaaaaccaaaccctcttatgtgatgagtaaaaaattcaaaattggccaggcgtggtggctcaggaatttgagaccaggctggccaacatggtgaaatcccgtctccactaaaaatacaaaaattggccgggcatggtggttcatgcctgtaatcccagcattctgggagaccaacatgggtgggtcacctgaggtcaggagttcgagaccagcctggccaacatggtgaaacccccatctctactaacaacacaaaaattagatgagcgtggtggcatgcacctgtaatcccacctacttgggaggctgaggcaggagaatctcttgaacccaggaggcagaggttacagtgagccgatatcgcaccactgctctccagcttgggtgacagagcgagactccatctcaaaaaaacaaaaaataataaaataaaataaaattacatgtggcttgcactcttagtatatttctgttggacagcactgactttatgttcactggctttctcaactgagttttgggagagaagccacaatacccaaggcatccttgatctgtgatggattgaccttagtgcattgagaatggtactagctgtataccacccttaggaaaacagagaaaatatatctctgttcagatggggaaccccagttgagaaaatctggaagttttaaacctccaggctgagcaccatgttaagatgtgggatgagtgagaggcaggcccttttatgtaaagtgggagaagggcagttaaaggcagttattatacaaggagaggtggaaaatgtaaactggcagaaatctgacatgtccttaggcagaaatctgacatgtccttagctcagtttaggaaagagtatgtatgagaattgagtgttttgaaactaattctcctttaggtattcatgccctggcttataccctccagaaggtatgtacagaagtagttgtaccccaacaagcagactgctcctttgaagccacatgactccattgagataagaacaaggacattcagtttttatatttttataagtgtaggatttcataatgagtaggataaatttaatatagaagggatgttttctaagtttatggttaatccttgcccaaggcatttgtgaaaacagattccagccatgcctcagttcttttccagtcagactgtctggatgggaatctgggaatatgaattgttaacaagcttcccagatgacttatactgtaagaagagtttgggaaacactcaagttctgtacagtcagctcctatttatatacggtatcaaagggaagaagacttgccaagtatcccatatattgttcacatccccttaaaacattacttggaataagttcattgatttgtagagccttccttgagcaccctagattgtatagacttgattgggaacaggatctgagctatttagagagggttgtttatatatattttaatttttatttttttgagatggagtcttactctgtctcccaggctggagtgcagtggcatgatctcggctcattgtaaccaccgcctcctgggttcaagtgattcttgtgcctcagcctcccaagtagctgggactacaggcatgtgccaccatgcctggctaattttttgtatgtttagtagagacagggtttcaccatgttggctatgctagtcttgaactcctgagctcaagtgatctgcctgtctctgcctcccaaagtgctgggattacaggcgtgagccaccacacccagcctgtttgtatttatgtttaacttggaatgtgtgggatttccaagttctgccagttggaacaaaataatattggcccattgggaagttggaacacaggaagagcctcagagttcaacagtcttctctggtttgcttcctcacacttcaggccgtgtcttgttgagccatttgaccgacctgaagctacaggtcttagatgagtcttttctgtccctcttcccctcttctcatctttctcccttcccttcctcttttcctcccatttacttctcttcttccctcttcctttcctccttcctcttctctctcctcctttcacccttcctgagaccccttagctctgccttcctgcccaacttcccagtttctttcttctgcctgccttttcaattctcatcttttctgatttggggtaagcttcttaggtggtaggtttaaaacaaaatagtaagggctgggcatggtggctcacgcctgtaatctcagcactttgggaggtcaaggcaggcagatcacctgaggtcaggagttcgagaacagcctgaccaacatggagaaaccctgtctctactaaagatacaaaattagccaggtgtggtggcgcatgcctgtaatcccagctacttgggaggctgaggcaggagaatcacttgaacccgggaggcagagcttgcggtgagctgagatcgcaccattgcagtccagcctgggcaacgagagcaaaactctatctcaaaaaaaagttaatagtaaatactatgctgggcaggtggctcacacctgtaatctcagcactttgggaggctgaggcgggcagatcacttgatgtcaggagttcaagaccagcctggccaacatggtgaaaccccatctctattaaaaatacaaaaaaaaaaaaattttgctaggtatggcaggtgcctgtaatcccagctacagggaaggctgaggcaggacaatcacttgaacccaggaggcagaggtagcagtgagccgagatcgtgccactgcactctagcctgggcaacagacccagacttcatctcaaaaaaacaagcaagcaagcaagcaagcaagcaaacaaaatctaaatagtaagtactcttcaaaggcttagcgtctgtactgctaaattatgtcagagctgggtttgctggggaccagcagccttgcctgaaacattgactgttaactagcatagtctcccaagaatttttttaggattttgtttaagaaaatacaaattctcggctgggtctcatggctcatgcttgtaatcccagaactttgggaggacgaggcagctggatcacttgaggtcaggaatttgagaccagcctgaccaacatggggaaaccgtgactctactaaaattacaaaaattagccgggtgtggtgtcgggtgcctgtaatcccacctactccggaggctgaggcaggagaatcgtttgcacctgggaggcggaggttgcagtgagcagagatcgcggcactgcactccagcttgggtgacagagcgagactccatctcaaaaaaaaaaaatccacaaattctcttggacatttttcttgtaccctcaaaactaggcccagtgctaagataattaatgtagcaagtagaggttgaaaactggagctggatcatagaaaagattcaggaggtcaattggcaaggtatcaccatctcctgtaaggaagtaatttctcactcattttactttttttcttttatcttaagtaagaatgcccttttgatggcccatttataatgcagtgatttctgcatatatatatgtatatatgttttatttatatataaaaatgacagacactaagaaattatgtatctttttttgtgtggttttataaacatggtagctgtggattcaaactctcaaactttgcaaccaataacattggaactgagaagaaggaaaatatcaaaaggatgtgaagtcccattaaaacgtcctcggcttgacaaaaattcatgtgagtctacagtttgtttatgtgtggctagaatttgacgttgtttgggtcaacttcctctatattcatcctgtcccccattccctataggctctaatgtttgtctctggtcacatgaggtaatgtgagttggatgcagttggatcagaaggagtttttgctagaagaaaaataaatcccaaagcacaaactgtactaatgttgggttctgtggtatcatctccatatccataaatcacatttgatttggatgccactggaaatttaatggcttaggaagggatgggtttcatatgcagagtgaaactttaaaaatactacttattggcctggcgcagtggctcatgcctgtaatcccagcagtttgggaggctgaggtgggtggatcatctgaggtcaggagtttgagaacagcctggccaacatggtgaaaccctatctttactaaaaatataaaaattagccgggtgtggccaggcgcggtagctcacgcctgtaatcccagcactttgggaggctgaggtgggcagatcatgaggacgggagattgagaccatcttggctaacatggtgaaaccccatctctactaaaaatataaaaaattagccgggtgttgtggcaggcacctgtagtcccagctattcaggaggctgaggcagaagaatggcatgaacccgggaggcggagctagcagtgagccgagatcgcgccactgcactccagcctgggcgagagagcgagactccgtctcaaaaaaaaaaaaaaaaaaaaaaaaaaaattagccgggtgtggtggcgggtgcctgtaatcccagctacttgggaggctgaggcaggagaattgtttgaacttgggaggcagaggttgcagtgagccaagactgtgccactgccctccagcctgggtgatagagtgagactctgtcctataaaaaataaaaatacaaaataaaatactatttattgatttaaaaaaataccctctggagtgagttggctcaaatgtttaaataaatttaaaataaaatagtatcctgttggctccaaaaaggatttgtgatagctctaagtaaggctcttataaacctttttaagtcgactttgcaagttagtacatttgggaagccccaaaatagaacatagttgtcaagattcggacatgacctagcacatgttttcagaccatgaatccttaaagaagtgaaattctatcctggcagggacacttttcccttacttaaaactgtaaactagtaaagggtatttccttttatcactactctaacattccagtagtctctctgtaaagtccttttagagacatccagccctgaaatctgtagtagcacagttatttcttcttgttggtctcttgactacaactctcttaatggtttaatagcccaggaaaagtcaaaaaactactcggaaaacactgacaaagacttatcgaggagacgttcctccaggctgtccactaatgggacccatgagatcctagatcctgacttggttgtatcagatttggttgatacggatcctttgcaagacacgttgtctagtaccaaggaatctgaagaaggtgagtcagtctgttcaggaattgtcttgccaacctggttcctatttagtgagaatcaatgtaaatcattatgttctgccttccacaagtattaaattgtcttgaaatcaaactattgaatgtgctgcagtgtttttataatgtattgctcttcactgatgatttattcaatagacatactttctggatgcatttgtggttggttttgcttatctaccgttcagtgttggcctggaggtacactgttcgaagagccctgcttctctctctctgctgccatctcattcgtgcctttgtgtttatacttccagctatttttcctttcactttaacctctttctttgagaagctcacaagccagcctgtatgtatgggaacctgtgaatgtatgcttttatgttttagattaattccttcctctaaaaagtccctggctttcttagactgttgtaggacttttgatttcagaattacatacatgtatatttcccccaaactttctttttttcttctaggtcagttgaagtctgctttggaagctggccaggtctcatctgcactgacttgccactcctttggggatggatccggggctgcaggcttggagttgaactgcccatcaatgggagaaaacacgatgaaaacagaaccgacttctccccttgtggaattacaagagatttcgactgtggaaggttcatatttagagttaaattaatcctctttttatatacacttttgcttatgctttgtgaactaaaaaaaaaaaaatgacttttctgttgttgtttttcaccttttattaatattcccttatcattttaatgttatgctcctttcatttctgattttgataatttgtgttccctctcttagtatgactagggctttatctattttgttttcaaagaactaactttttacttcaattttctctattgtttatttttaaaaatataattgatttctgttttgatcttgctttcttccttcaattttttctagaactttacctaattgattttagatctttcttccttttttttttcattacctggtgaaaagatctttcttcctaatatgagtatttaaagttataaatttctggctgggcgcgatggctcatgcctgtaatcccagcactttgggaggccgaggtgggtggattgcctgaggtggagagttcgagaccagcctggccagcatggtgaaaccccgactctactaaaaatacaaaaattagctgggcatggtggcaggcacctgtagtcccagctactcgggaagctgaggcaggagaattgcttgaacccaggaggcggaggttgcggtgagccaagatcatgccattgcactccagcctgggcagcagagcgagactcagtctaaataaataaataaataatgaaattatacatttcccactgagaactgctttagcagcatcctacacattttgatacgttgtgtttttatttttgttcaatttaatatatcttgtgatttatttgttgaccatgggttacttagaagtatgttgtttcagtttgaagtattttatgtttttgtagataccttattgctattgatttctaatatagttttactgtggtcagagaacatactctgtaggatttcaatctttttatatttgttgcgatttaatttatggtccagcatatgatctgtcctggtgaatgtttcatatgcacttgaaaagaatgtgtattttaccgttgtcatgtgtttgttctgtatctgtcagttagatcaaggtagttgatggtgtttctctgataaattgatttttgtggggtttttttccttttggtctagttctgtcaatttctaagagaaggttgttaggttgttaaaatctctgttattgtggatttgttcatttctccctttaattttgtcatttttgctttgtgtattttgaagatcttttagatgcatacacatttataattttttttttttttgagacagaatcttgctttgtcacacaggctggagtgcagtggttgatctccactcacttcaacctctgcctcctgggttcaagcaactctcatgtctcagcctcccgagtagctgggattacaggagtgtgccaccacgcccagctaatttttgtatttttagtagagacagggtctctccgtgttgaccaggttggcctcgaactcctgaccacaggtgatctgcccacctcggcctcccaaagtgctaggattacaggtgtgagccactatttctggcctaaatgtaattgttgatatggttggtttttaggctaacatttggctgtgttttgtctgtttttttgttttttttttttttttttttaagacagagtcttgctctatcgcccaggctggagtgcagtggtgcgatttctgctcactgcaacgtctgcctcccgggttgaagcgattcatctgcttcagcctcctgagtagctgggattataggcacccaccaccacaatcggctaatttttgtattttttagtagagacggggtttcaccatgttggccaggctggttgtctgtttatattatttgtgttttgttgttttgtttcttgttttttaggttaactgattttttaagaatttcattttaattcatctgttagcttttagctgtatttctagcattttgaaagaggttactctatggattatggtatacatccttaacttctcacagttcacttagagttaatatttaaccactttatgtaaaaatgttccattaacctcccccatgttgtagttgtcacatgaattatatctgtatatgctataaattcctttttaaaaaattttttatttacatatttttttgagatggcatttcactcttgttgcccaggtggagtgcaatggcacgatcttggctcactgcaacctccacttcccagattcaagtgattctcctgcctcagcctcccaagtagctgggattacaggcatgtgccaccacgcctggctaaattttttttgtatttttagtagagatggggtttcaccatgttggtcaagctggtctggaactcctgacgtcaagtgatctacccgccttgacttcccaaagtactgtgattataggcgtgagccaccacacctggcctgctataaatttcataatgtagtattataagttttgctttacacaattatgtatgttaaagacgataaggcaaaaagcgacagtcatatttacacatgcctatttccaatgttctttatttcttcgaagatttcttttcagcatgaagaatttccttcagattttcttataggttcctgatgacaaattcttctggtttttgttaaaacttgactttttttttttaaagatagagtctcactctgtttcccaggctggagtgcagtggcacaatcacagctcagagcagcctggacctcctgggctcaagtgatcctcctgtctcagtcacttgagtagctgggactacaggcgtgtgccaccatgtccagctaattttttttcttttctcaacttttagttaaaaaacaaacaaataagactgtgtgtctatagaattgtctactttttatttggataacttaaaaaatttttttttgaatagtttttttttttcttggccagatgctatatagttaacataaatgtagtagagcagctgtttgaaaatagtgaatctcagcactctgggaggttgagactggagggtcacttgaggccaggagttcaagactcgctatattgaaggccttgcatcaacatagtgagaccctccctcttcaaaaaataaaaaaattagcctggcatgatggttcatgcctatagtcccagctacttgggaggcggaggtgggaggatcacttgaaccagggaggtcgaggctgccttgagctgtgattgtaccactgccagcctgggtgacagaggaagaccctatctcctaaaatattttaaaaaattggccaggggtggtggctcacgcctgtaatcccagcactctcggatgcctaggcgggcagatcatttgaggtcaggaattcgagaccagcctggccaacatggtgaaaccccgtctctactaaaaatacaaaaatttgctgggcttggtggcgcacgcctgtagtcccagctactctggagattgagacaggagaattgcttaaacccagaaggcagaggttgcagtgagttgagatcgcaccactgcactccagcctgggtgacagagtgagattccatctcaaaaaagaaaaaaaaaaaattaaaagagtaccgaagtattcattcctagctcatctcggcggctgttctcttagttctctgtctagcttcgtccatagtgttgtgcttcagcctcgagggcttgtcggggcaagggatcttcctttttttgctactcctcctcttagtgtcagggctcttttcttcccagcctgctcttctgacatgtggggcaaattactaaagttcatatgtaaatgaggtggaaatttaatctcggaatttagttgtctgtcttggcagggagaactctagatgacagccacatcccctgtgactcagcagactaagcttttaattatgttgtcttaagggtagtggtatgttagacgtcacttgaaatttgtagttaattgttcctacaccactaggaaacacgccatgcatataagtgaggagactagattagaagctaactccagtgccttttgtaaagtttacgtattttatggggtcttgggctatactttttcccaaaatatacacatacataatttctgtcttgtgttagctaacctaattatgtttctggattgtggagaggacagaatcaagtatagtaagggtgggacaggtgagtctaggggaaaaggatgatgatgagatttcatgtcgtcgtctgcatccttacaaaggtctcacagtagcctttctaagggaataattttgaaaccattgcaactgattgaagcacttatctattttccaagagggttaatagtaagggtggaggtcaaattactttgagcttgagccaagaggaataaatatagcatggaacccattactgtatttttttttttgaatgaggtatttgctttttgctttagtgacttaaaagccagaagagatggccgggcctggtggctcatgcctgtaatcccaggactttgggaggccgaggtgggcagatcacttgaggtcaggagttcgagaccagcctggccaacatggtgaaaccccatctctaccaaaaatacaaaaattagccgggtatggtggcaggcgcctgtaatcctagctactcgggaggctgaggcaggagagttgcttgaacctgggaggtggaggttgcagtgagccgagattgcgcccctgcacccagcttaggtgacagagcgagactctatctcaaaaataaaaaaattaaaaagccagagacgaatgcagttgtgactgttgtaattgggcaagcattcatttatgcagtaaaacagaagttagtaattcccctagaagtttagaggtctcaggctgggcgtggtggctcacgcctgtaattctagcactttgggaggccaagacgggcagatcacctgacgtcaggagttagagaccagcctggccaacatggtgaaaccccatctctactaaagatacaaaaatttggccgggcgcagtgtctcatgcctgtaatcccagcactttgggaggccgaggcaggcggatcacaaggtcaggagatcaagaccatcctgtctaacacggtgaaaccccgtctctactaaaaatacaaaaaaattggccgggcgtggtggctggcgcctgtagtcccagctacttgggaggctgaggcaggagaatggcgtaaacctgggaggcggagcttgcagtgagcctagatcatgccactgcactccagcctgggcgacagagtgagactctgtctcaaaaaaaaaaaaaaaaaaaaaaaagatacaaaaatttgctgggcatggtggtgggcgcctgtaatcctggatacttgggaggctgaggcaggagaattgcttgaacctgggaggaagaggttgcagtttgccgagatcgtgccactgctctccagcctgagagactccatctcaaaaaaaaaaaaaaaaaaaaaaaagagtgagactccatctcaaaaaaaaaaaaaaagtttggaggtcatattattatctgaaaatgggctgctgcaaatatttagcaagtgcctagtaagtgccaatgccagaccctattcttttctttcttttcttttttttctttttttatttttattttttatttttgagacagtctcactgtgttgcctaggctggagtgcagtggtgtgatttcggctcactgcaacctccgcctcccaggttcaagtgattctcctgtctcagcctcccactttcttttttttttttttgaaggtggagtctcactcttttgcccacgctgtagtacagtggtatgatcttaggtcactgcagcctctaactcctggtctcaagtgatctcctgcttcagcctcagaccctattctaagctgtctcattggttgatactctacaagaagcacagaataaacaagagagaaaaacaaatagaagtacaggtccattcagttaagttctttttactaaatacctggtagaagtgggacactttgccacaggatccagatcagtgattctaacccatgaaatcttgctgtgtttgttgttagttataaaacgaatgaattgtcactgaagtatcaaaaattaacagatgatttacttataaattaactagttaagatttagcatgatgactataatagtttttgcaaattatttacttttaaattaaccagttaagatttagtgtaatgcctatagtattttagctttaatgaatttgtgttctctatggtttcttgagcaggagagtcatagatctacagccattttagtttgggaaattgtgtgtgtctatggtttttcatatcatcaagtatgtattgtgatggaaactgatagagaattcattattctgggggttagagagatgaatgcgacatctgttctaggcccttccaggtctttctgtccagacgaatggatgagacttcagatacctatgatacaagaaagtaagatgatgtcatgacaaacttagaatgaaactatgagaatagagagaagaatgacagtgaaaatgtgtgcctgctacatagaaatggacctcttcaggttggcgtgtgcgagattttcttgctctagggagattgtttaagcaatcactatgtcgacaaacacagatgtttccctttctgaattcatatgatgaagatcagggatccaaacttattcaaaaagctaaagaggcaccattcgtacttgttggaatagaaggttttgcagcaattgttgcatatggattatacaaattgaagagcaggggaaatactaaaatgtcccttcatctgatccacatgggtgtggcagcccaaggctttgttgtaggagcaatgactgttgttatatcatgtatcgagaattctgggcaaaacctaagccttagaagaagagacgctgtcttgctcttgtaggaggagcttgttttagttagacgtctcattattgaagttacgtattattgttgaaaataaactaatttgtatgggtttagatggtaacacggcattttgaatattggcttcctttcttgcaggcttgatttgcctgttgactgaattactagtgactagtttactaactaggtcattcaaggaagtcaagttaacttaaaagaaacatgtcacctaaatgcacttgatggtgttgaatgtccaccttcttaaattgttaagatgaacttagttctaaggaagataacaggccaaccctgaagtactcccagtttgctgcagaatctcacatattttggatgttatagaagagtcctatttgccctagttaatttaactttttttttgcctgttttgtggactggctggctcttttagaactctgtccaaaaagtgcatggactataacttgtaaagcttcccacaactgacaatatatatatgtgcatgtatttaaaccaaatctggaaaacttacaatacagctgcataatggtagtatttattaaagaatcacaattgtaaacatgagaataacttatggattctagtttagttctttagtaattgcaaattatatttttgctgttgttatattagaataatttttgaatgtcatcttgaaatagaaatatgtattttaagcactcatgcaaaggtaaatgaacactgtttaaatgtgtgctttgcttattttttctgtaacaatcgtaaacattaaactgaacaaattacctacagtagttttgattaatgacctaagagcaagctggtttggccagacagtgtacccaaacttttatataccatcgaatgttattacacttgtgaaattctcctgtctaacctgaatttacattccatggtggttacatggtatatgtattattattaaagtaagtgagccatgtcaaaaaaaaaacaaaaaaacaaattgacctcttcaagaccagcctgggcaacatggtgaaaccccatctctccaaaaaaaaaaaaaaaaccctccaaaacaaaacagaataaaaccccaaaaaaccaaattagccgggtgtggtggcatgtgcgtgtaatcccagctacttgtgaggctgaggtgggagaatcgattgagcccaggaggtcaaagctataataagccatgatcatggcaacactgtgctccagagctgtgacagagtgagaccctgtgaaagaaggaaagaaagagagaaagagaaaggagagagagaaagaaattaattgacttcaactcacttactgagcctttaccatatgcctaggactgctaactgttgcgtatgcaaagatgagtgggcactcttggacttagtgttcattaactgctatttggatttgctatttgcctcttggggagaggtgatacttaggttggtgctttagcggcagggatggaagaaggcggtacttgcacgggaacctgaaggatgggcagcagttaggcatttgaaaatggaggcaaagcagctagcacagcatgaccatagggcgatttctgagactgtcaggtatgtgttttgaggtaattgcagacttcctgaagtgggttaaggtggggtaagttgctgccaaactgaggttggttgctttgaggaatttactgagaaactgaaaaatgcttcattttcaggatagggagatagcctgtgttggcaggattgctttccttccatttagctattttgtggccataaggtattttttctgcatatattttaaagaagtttttattttgaaataatttgttattaaaaatgttgttaaaaaatggtacaaagaatatacctttaaccaaattccccaattgctagcaatttaccatatttactttattattctactctttaaagtactttttctagatgggatgcggtggctcatgcctgtaattccagcactttgggaggctgacgcgggcagatcacttgaggtcaggagttcgagaccagcctggccaacatagtgaaaccctttctctacaaaaataaaaaaattagtcaggcgtgatggcacatgcttgtagtcctagctactcgagaggctgaggcaggagaatctcttgagctcgggaggcggagattgcagtgagccaagattgtgccactgtactccagcctaaatgacagagcgagactctgtctcaaagaaaacaaaaattaaaaatttttttttagaaagtactttttctgaattgtttaaaaataagttccagacctttatctctaaataccttttttttttttttttttttttctgagacggagtttctcgctcttgtcacccaggctggagtgtagtggtgcgatttctgctcactgcaaccttcgcctcctgggtttaagagattctcctgcctcagcctcctgagtagcttggattacaggcacgtgctaccatgcccgactaatttttgtatttttagtagaggctgggtttcaccatgttggccaggctagtcttgaactcctgacctcaggtgatccacccaccttggcctcacaaagtgctgggattataggcgtgagccaccgcacccggcctccctaagtactttttagaaaatcccatatttaattagctgggcatggtggtgtgcgcctgtaatcccagctacttgggaggctgaggtgggcgaattgcttgaacccaggaggtggaggttgcagtgagctgagatagcaccactgcactccagcctgggcgacagagcaagactctgtctaaaaaaaaaaaaaaaaagaaaaagaaaaaaatattccatatttcctaaagacaaggacattcttctacattaccacagtataattttcaaaatcaggaccttcttcagactttatcagtttttgcctttcaccccatttatggcagtcatcttgtttttattctatatgctttttttgggcaattgaaaaaatattcataaatttgaaaagaactccagaaatatacaaggataattcaactaacattcttgtctcccatagtcccatggcccactactgttagtatttggtcatgagggcctcagggccatacactggcctgcagggcccagcttcttctggccacctgttgcctcaccttcctattgattctgctgcagccacatggcctccttgctatcctgcaggcataacttacggattctagttgagttctttagtaattgcaaactatatttttgctgctgttatattagaataatttttaaatgtcatcttgaaatagaaatatttattttaagcactcatgcaaaggtaaatgaacactttttaaatgtgttcattgcttattttttccataagaattgtaaacattaaactgaacaaattacccataatggttttgattaatgacttaagagcaagctggtttggccagacagtgtacccaaacttttatataccatagaatgttattacacttgtgaaattctcttgtctaacctgaatttacattccatggtggttacatggtatatgtattgttacactcctacctctgggccttgttcaagcacacttttattgagtactttttatccccagccagagcaagtagatccattgggaacatatcagtaatgtgatgggtaatatttatttatgtattcattcatttatttgtttgagaagggttttgctctgtcatccaggctggagtgtaatggcatgatcatagctcactgcagcctcaacctcctgggcttaagccatctttccacctcagcctgctgagtagctaggactacagacatgtggcaccaagcctggctaatttttaaattttttgtggagacagggtctagatatattgaccatgctagtcttgaactctgggcctccgccttggcctcccaaagtggtgggattggaggtgtgagtcactatgcccagccctatcttctttcacaattacatataattaggccaggcacagtggctcaagtctgtaatcccagcacttttggaggccaaggcaggcagatcacctgaggtcaggagttggagaccagcctggacaacatggcaaaaccctgtttctactaaaaatacaaaagtttagccaggtgcggtggtgtgtgcctgtagtcccagctactcaggaggctgagagaggagaattgcttgagcgtgggaggcggaggttgcagtgagccaagatcacgttattgcactccagcctgggtgacagaacgacactctgtctcaaaaaaaaaaaaaaaagaaaaaagaaaaagaatataattagctaggcattgtggcacacgcctgtagtcccagctactcgggaggctgacatgggaggatctctctaagcccaggcattcggtgttgcagtgagctatgatcctaccactgcactccagccttgacaacagagtgagaccctgtctctggaaaaacaaaaacaaaaacaattacgtataatttatttcattgtatggatgttccataatttatttacctagcccctgctgaaagatatttaagttctttctaacttttccctattaattctccctgttttacagacaaagagcctaatatttggcatgaaggagtgagttagctagagtggcacacttcctaatggtcagtattgtagaggttggtaaaattaaattaaatttttgtttgagacagggtctcactctgtcatccaggctggaatgcagtggcgctgtcacggctcactgcagtgttgacttccagagcttcagtgatcctccccactgttcagcctcctaaatcattgggaccacaggcactcgccgtcactcctggctaatttttgtattttttgtagagacagggttttgccattttgcccaggctggtctcaaactcctgagctcaaccgatccacttgcctcggcttcccaaagtgctggaattacaggtgtgagccagtgtgtctggcccagagtctgtaactgttgttttcctgctgagtgcctaattccatctgataagatgctgggtgctatataaatcaagtgaaatgaacagagtccctgcctttaggggcattgcacagtatgtgatgcaaacttctgctctcggggcactcattaaagcagtgtgtacactcagagtaagaggcttagtagggtggctagatttggagggtggtgtgtggtacaagtgatgtcagtactccaggactgggtggtgccttttgaattctttgagttgtggaaaatgtcttgatctggaaactgaatggtgtttctggtgtttctttggaaacataggtttagtggtgtgagtacaggacgatccagaaagattgctgggggaaagggaggttgttgagaactcattcaccaggaatgtattaacgtaagtaagcggaaatagggcgggaccatgaccatcttcagaagcatccagccaggtccctggaagctgggatgctgcgttagtcactgtttagtgttgctttcctgagtcggtgccatagtcttgcgtttttaaaccgagatggagtcacaatctgagaaattggtgtgaaggaggctcatgggcagcaggaggaggaggagctgggagggcaacacatctagtctagggctagctgttccaacctaactctggcatttggggcagctctgccaccttgtggaatgagtgctcagtgatttctgtgggggctgagtgcagagatctgcattccaggggctagccttgaaatgttcaccaggactatatgtcggtgtggttcctttccttccacttgagtatttgtggcttcaaagtatttttcctacgtatgtagatgcatattttttcctgaatatatttttaggaagtttttattttgaaataatttagacttatacatctatgtagcatgggttaaaagaatgacaaaaaataatttcagatttataaaaaagttgcaaaaatagcaaaaagatttcccttatacctttccctatgttggaaaatatagattccccaattgctagcaatttaccatgttagctttattattctctcccagattttattttatttcattttttgagatggattctcactctttcgcccaagctggagtgcagtgatgagatcttggctcactgcaacctccacctcctgggttcaagcaattctcctgtctctgcctcccgagtagctggaattacaggcacacgccaccacgcctggctaattttttttgtacttttagtagagatggagtttcaccatgttggtcaagctggtctcgaactcctgacctcaagtgatctacccaccttggcctcccaaagtactgggattacaggcatgagccaccatgcccagccctctcccagattttttaatgtagtttttgaattgtttgaaaataaattgcagacctttagccctgaatatttcagtgtgtatttcctgaaaacaaggacatcctctttcattcccacaatataatcaaaatcaacaccttttaaaaactttgccatttgttctaataatgttctttgtggaaaaaatgggggtaaattttttttatttctggtcaagatccaatccagatacacacgttgaattcagctgtcatatttcttttgtcttctttaatctgaaacagaccttcagtcttctactttttttactggagtgggggacaggggaataagctttttttttttttttttttttttttttttttttactttttaaaaatgagatcttcagtttttgtcttttatgaccttgacattacatttctgaatatgatatccctcaatttgggtttttctgatgtatcctcataatttgatttgggttattcactttccacagaaataccacgtaagtgatgttgtgaccttttcaggtgcattctatcaggaagcacatgaaaacctgtttgtcccatttactggtgacattaacttttatcacttacctaaggtagtatctaccagctttttctactataaagctgttattaccccctttataatgaatacatttcttgtgagagaaacattgagactatgtaaatatcttatttcctcatcaaactttcacccattattttagcatctactggtatttcttgcctgaaacaatttttactgtgatggctgccaaatggtgatatctaactttcatcattctttcaacatgtattagtttatattctgccttaggggggtttaatctcacttctttccttcctttccttgtttgtttatctgcatgggctcatggattcttatgtcgttctatgggttataatctgtttctatcattatttattttaatgccaaaaaattataatcttgagattatgtcagtaaatactttttttttttttttttgagacagagtctcactctgttgcccaggctggagtgcactgatgagatctcagctcactgcaacctccgcctcctgggttcaagtgattctcctgcctcagcctcccaaatagctgggattacaggtgcccaccaccatgcccagctttttttttgtagctttagtagagactggtccaggctggtcttgaactcttgacctcaagtgatccgcctgcctcaccctcccaaagtgttgggattacaggtgtgagccactgtgcctggccttcgctaatctttgattgctttttgatgcttcaagctgaaaaaattattccttcatagacatgaaaaatattttattcattatattatgtgaaatatatatcaaaaaggtatcaaactgctgggccacatggcgtgattgccgacaagaatagcaactgtgttgggccttggtcctgagggaacacatgacaatgagaagtggctcttttcccctggctggagaagtgacaaataacaggatccaggagcagatgttaagtgctgatgatgaggtagagcagatagtcatttgtggcaggaattgatggcatgtggtccctgagagccagggccatctggatgtctttctgtttgtggagtgagctgggtctggatggaagtgaagacttggctgagccagggaggaatggcaggaagagggcacaggccaagcaggggtgtgaactgcgagagcatgaagcagttgctggagcaggagctgaggcctccttatggatgaatgggaggtgcgtttggaagcaagatgccactattggagtgacgtgggccttgaatgccagactgagcattgccagccagacggaatatcaccatcatcataatctaatcatagtcatccagttgtgaggtcatctgatactggcaatgggtacacaaaatattaaataggatatttatttctaagccaaatttcagaaaacaatttacaaactttttttaaagtataaacatagtgtatgcttactataaaaggaaaagtataaaacattactcaagtatatatagaaaatgagtgggctgctgatccccctctatattatctattgctgtgtgacagtattaccacaaatacagtagctgaaacaacacatttgttttctcacagtttctgtgggtgaggagttcaagcatagcttggtcctctgcaagcttacaatccaagggttggctcaggctgtattctcatctgagcactctactggggagggtttcaggcttacctgatggttggcggcattcagtccttctagactgtcagactgagggccttggtttttgctggtgcactcagttccttgcttcatatagagtagctcacaatgtagcagcttgtttcactaagacagcaaggaagagtgtttcctagtaagacagacactgtagtcttacctaatacaatcatgaaagtgacatactgtctccttcgccatattctgttagagacaggttacagctttgcccagtggcagtatcctagccaatgaggtttatctgaggcatgattattaaaataattgaaaattttcccaatacaccaaagtgacaacttacaacataggttggcaatggcaatttttgacatgtctacaaagactgaattaaaaaaaaaaaaaaaaaaaagaagaagttacaggttctgcccacactcaagaggaagagattatatcagggcgtgaataccaggaggcagggattattaggaaacattttagggtttaactccacaccctcccccgaaaatagataaagaaaacactgcttagggttaccttttttttttttttttttctgagacagagtttcgctcttgttgcccaggctggagtgcaatggtgcgatctcggcccaccgcaacctccgcctccctggttcaagcaattctcctgcttcagcctcctgagtagctgggattataggcttgcaccaccatgcccggctaattttgtattttttagtagaaatggggtttctccatgttggtcaggctggtctccaactcccgacctcaggtgacccacccaccttgacctctcaaagtgttgggattacaggtgtgagccaccacgcctggcctagggtaaccattattaaaagcaaaatttgtggaccatttttctctgcacataccaaagtatagtagtaatttaggaacaacaagagcaaagggtgactgttgagattttgagcctggatgcccaggagagagctctgtgctttttcttgattcctcctaacaataatttgttaaacaggagggagaggacagagcaggtaaatgataatatcagtaactacttggaaatagtgattttcatactgcttttaaaagaggaataaactggtttcagtagatgaccttatcccaagagtaattgagttccccctcacttttgaaccagcaactttaagatttaatttacaatattttcttctgggcatggtggctcatgcctgtaatcccagcactctgggaggctgaggcaggaagatcacttgagccaaggagttggagatcagccttgggcaacatagggagaccctcatctcttttttttttttttttaattaataatttacatgtcttctgccctctgtctctgagtaactgctctcatgttgacaagaaccatattagtatgctaagggtggatgatgtcacttagtggtgtcaccagctgctgccatgtatgttctaaatgaactgtcctcccataggggaatacatacctgtgtgtgagactgggatttatgtagactttggcccagcaggcccatttgacaaccagtggccctcttagtttctttttttttttttttttttttttttgaaatggagtctcgctgtgtcacctaggctggagtgcactggcacaatcttggcttactgcaccctctgcctctgggctcaagcgattctcctgcctcagcctcctgagtagctgggattataggtgcacaccaccacgctcagctaacttttgtatttttagtagagacggggttttgtcatgttagccaggctagtctcgaactcctgactttgtgattcgcccaccttgtcctcccaacgtgctgagattataggcgtgagccaccgtgcctggtgctatacataattttctattttgctcgtaatattttgggttttattttttatttttatttttattttgagacagagtctcactctgtcacccaggctggagtgcagtggcacaatctcagctcactgcaacctccacctcctgggttcgagcaatttttgtgcctcagcctcccgagtagctgggacaataggcacgcaccaccacgcccggataaatttttggatttttagtagagatagagtttcaccatgttggccaggctggtcttcaactcctgacctcaagtgatctgcccatctcagcctcctagagtgctgagattacacgcatgagccactgtgcttggccatattttgagttttatttcgcatagttataccatgcatattctgtttcttaattaattaattaattattttaaaattatttttgagacagggtctcactctgttgcttaggctggagtctcagtggtgcaatctcgtctcactgcaacctctgtccccaggttcaagtgattctctcaccttagcctcccaagtagctgggactagaagcatgcaccaccatgcctggctaatttttgtattttttggtagagacagggtttcctcatgttgtccaggctggtcttgaactcctgacctcaagtgatccacccaacttggcctcccaaagtgctgggattacaggcatgagccaccatccctggccctatttatttatttttgagacagttctgtctcactgttgcccaagctggagtgcagtggtaggatcatggctcactgcagcatcgacctcctgggttcagcctgtcctcctgcctcagtctcctgagtagccgagactatgggtgcatgccaccacacccatctactttttgtattttttcgtagagatgggggtctcactatgttgctcaggctggtcttaaactcctgggctcaagttatccacccaccttggcctcccaaagtgctggaattacaggcacgagccactacacctgacctattttaaaatgtaggatatttttgctgaatgcataattttaatgttcctattgtgattttattaattatcactaatccttcattgtttgattaataaaggagggcaattagatgttagaattttgcagattgtaccagtgacacatggtcccttggctagaattatgcataactttgattgttttgagcaaacaactgtgaggtcagtgacaacaataatgacaaataatattcaagtaacctcttgctgttaatactgggttttgtggccaggcacagtgcctcacgccttgtaatcccaacacttcaggaagccgaagtgggcagatcacctgaggtcaggagttcgagaccagcctggccaacagagtgaaaccccatctctactaaaaatacaaaataattagccaggcatggtggcacacatctctaatcctagctactcgggaggctgaggtaggagaatcacttgaacccggaggtggaggttgcagtgacccgagatcgttccactgcatttcagcctgggtgagagagtgagactctgtctcaaaaacaaaacaaacaacaataaaacaaaacaaaactaaacaaaactgggttttgtctttaactgcctcatggaaacatataggagagttgtgaaataagtattcttattcccatttaacaatgaggaaacagtcttggagaggctagctcccatgtttgatgtgacagtacactaacataagtaagagaagtaaagaatgcagcacattccaggccgggtacagtggctcatgcctgtaatcccagcactttgggaggccaaggtgggtggatcacttgcagtcaggagtttgagaccagcctgtcgtaaatgacgaaacccggtctgtactaaaaatacaaaaattagctgggcgtgatggcaggcgcctgtaatcccagctacttgggaggctgaggcagaagaatcgcttgaacccaggaggcggaggttgcagtgagctgagatcatgccactgcactccagcctgggcgacagagagagactctatgtcaaaaaaaaaaaaaaaaaggcagcacattgggtatttcaacattttagaaaaaggaataaacaaaaccaactgttatacaaatagaaagggaaggactacaggatccataaaatacttacaggaattcttcgaggcaggacagaatcttttctgctgagagaccggggtgaaggcattgtgcaaggaggtggtatttgaaggatgagcaagacttggtttgcatgtgggaacaacatgccaaatagagggaaccacatggcctagactggctgaactggcagcctttattgtgcatacagagggctccttttggctgtgcaaaaattaggataaggttgtgaagtctagaaaatataatttttcatgtctctaaatatttgggttcaaaagtaaaatagtccaatttgcaaaaccttcacgagaaagggacgattgcttaagtcttggtgtttatgtgtcttttttgttattctattttttatatattatttatttatttatgtactttttgagacagagtttgtcactgtgttgcccaggctggagtgcagtgggcaatcttggctcactgcaacctccgcctaccgggttcaagcgattcacctgcctcagcctcctgagaagctgggattacaggcatccgccaccacccccagctaattttttttgtttttttttgtttttttgttttttttaagcgggggacagtctcgttctttcgcccagtttcaagtacagtggcgtgatattggttcactgcaacctttgcctcccaggttcaagcgattctcctgcttcagcctcccgagtagatgggactacaggcatgcaccaccacgcctggctgattttttttttttttttttttttgtatttttagtagagacggggtttcaccatgttggtcaggctggtcttgaactcccgacctcaaatgatctgcccaccttggcctcccaaagtgctaggattacaggcgtgagccaccgcacccggccaattttgtatttttagtagagatggggtttcaccatgctgctcaggcaggtctcgaactcctgacctcaggtgctccacctgcctcagcctcccgaagtgttgggattacaggcatgagccaccacgtctggccttttttgttatattataatttaacatatcctaaacattttctcatcattaaaaagttaacataaacattttattcatatataatatttttatctacttttttttctttagagctctacttctggaagaatctactttttgatttgtggttctgaaattatagcaaattgtgtaatttatcatattttatcacaggctagtatgcattactgattcataccctgtttgcagcttttctcactctgatgcttgtgttgattgttttttccagcagtgcagggtagattatcaactggcttataatcagaagagcttgcttgtatcacagtgagttatacttcactgatttcactgggaaatcttacttcctgagtttccatggttaaagatttgtaatgctcaaatcttcttttgatgtttattccatcagagaaaacagaaactactttgtcttagtgttgccaaattgaaaagagcctttggtttggccaggatctttgtgatagtggcacctggcagtgtcttccctcctgaggagcatccgtgctcacttgagcctctctgatcctagtactgcctgtcagaggcagctggtccacctgagtgccaagctggcgctcctttggagtttcagctgtactaacttttgcttagctgtgaggaatcaaggattttgcttttgcagggggaatttttaacctgtaaactaaactcgcttgctttgaaaggtttactagattggcagattattagtctgattattagtccagtcatatctatctttcaacagatagtttggccatgacttttttttttttttgagatggagtttcgctcttgtcacccaggtcaatggtgtgatcttggctcattgcaacctccgccacctgggttcaagcaattcacctgcctcagcctcccaggtagctgggattacaggcacacgccaccacagctagctaatttttgtatttttagtagagacggggttttgccatgttggccaggcttgtcttgaactccttacctcaagtgattcacccacctcggtctcctaaagtactaggattacaggcatgagccaccactcccagccggccatggcttttttctttttttgttttcagacagagtttggctcttgttgcccaggctgcagtgcaatggtgtgatcgcagctcatttcaacctccacctagcaggttcaagtgattctcctgcctcagccccccgagtagctgggattacaggcacctgccaccacgcccagctaattttttgtatttttagtagagatggggtttcaccatgttggccaggctggtcttgaactcctgacctcaggtgatctgcctgccttggcttcccaaaatgctgggattacaggcatgagccactgtgccccgccaacatgtactgttatttatgttttaaaaagataaaacaatgttcagtattttggtggaacaagcttggtactatcctgcattgtatagagtattacaaaagaaaatctttaggtgtcatagtaaaagatgtcccaaaaggtggagataataatcacactgaaatgtgaatagtcatactaggaaccttgtggttggttttgaatttcacactttcaggaggacgtagacgaaatgaagtgctttcagggtgatatgcgtcccagccagggcatatgaagactggttgaagaaatgtttcacacttggttgataattataatagctgtctccagccatgttccagaaataacataagcctgcttatgatgtattttatatttgaaatgataatggcttccatgtgttgatcacctactttgtgccaagtacatacattatccataaccttttctccaaatctttgaaataggtggtattcttcccttaagaatctggataattagactagcttgcacagctaatttatgctgctaatgaaaggtagacctgggattaaatgttgtgctttttgtactataccatactgcctctggcatgagcatgcagtgaggctgtgggtggtggacacttcccctcttctgcttatgatcaggttaattcctgaaatttaaaatgacattgaatagtcatagtagataatattgagcacttatgtgccgtacacctttctaagctctttgcatgtaatttatttaattctcacaactcagcgaagttgttaccattatcgtctccatcctgcacatgaggaaactgaggcaaggggtgtaggtggaagaactcggttttgaaataggctgtccagctgcagaacccacacttagcccctgtactgtttgatttatgtagatgaccattgtgtatacacaagagtgcaagtttttgtttttgtttttgagacggagtctcactcttgtcacccaggctagagtgcaatggcacaatctcggctcactgcgatctcgacctcctggttcaagtgattctcctgcctcggcctcctgagtaagctggatctacaggcgcgcaccatgcccagctaatttttcttcttcttttttttttgagacaaagtctcgctctgtcgcccaggctggggtacagtggcgtgatcttgacccactgcaacctctgcctcctgggttcaagcaattcttccacctcagcttcccaagtagctgggactacaggcatgtgccaccatgcctggctaatttttataattttatttgagacaaggttttaccatgttggccaggctggtctcaaactcttgacctcaagtgatctgcccacctcagcctctcaaagtgctgggattacaggtgtgagccaccgtgccccgctaatttttgtattttagtagagatggggtttcgccatgttggccaggctggtcttgaactcctgactgcaagtgatctgcccgcctcagtttcccaaagtgctggaattatagtcgtgagccactgcacagggttccagccttagtcttttttagcctacaaaatggcaagtttatatgatttaacctaatatagatcaagggaaggatattccaaaataaactattttttgttttaggaaagaattggatgtattaaagttttgtgttttgaacttctccactgacatacttttcctgtccaattatttgtctgagaagtgtgtattctgtttcacatcgtgtcacttttgcttctccttttttttttttttttttttttgagacagagtttcactcttattgcccaagccagaatgcaatggcgcgatctcagctactgcaaccttcgcctcccaggttcaagtgattctcctgcctcagcctccggagttgctgggattatagatgcatgccaccacgcccagctaattttttatatttttagtggaaatggggtttcaccatgttagccaggctggtctggaattcccgacgtcatatgatccgcctgccttggtctcccaaagtgctaggattacaggcgtgagccatcgcgcctggccaactttttcttctcttacctgcaactaattgatctggcatcttttatatctcttgttataggtagaaagtgattttaaggcattatgctttgggatgtgtgtgtgtgtgtgtgtgtgtgtgtgtgtgtataggtttttgttggtttaaattggctctataacagcatccttcagacaaccaaacctaattttgaagtgtagagtataatttagatcaaatttaagagttttaaaattacctctgattatgggatgacacttgaaaaagtaatcataatacttaccaaaggtttaacaggctacctgcttccagtggagattgtgtgattgtgtttacgaaaaatctgattaactcaagaaagggccattcattgcataccgaattcctaattttttaaaaaaagatccatttaatataatatattcttgggtgaccaaatctgtagcataggaatgacttaatgtgattttttgttggtgggaagacattctaaagggagtcctcaataaactgcatttctaacacacaagaggttcttgtggcctgggggcggtggctcacacctgtaattccagcactctgggaggctgaggcaggcggatcacttgaagtcaggagttcgagaccaggctggaccagtctctactaaagctatgaaaaaaaaaaaactggacgtggtggtgggcatctgtaatcccagctactcaggaggctgaggctggagaatcgcttgaactggggaggtggaggttgcagtgagccgagatctcaccattgcactccagcctggacaaagagcaagactccgtctcaaaaaaaaaaaaaaaaaaaagtccttgtgatgggtttactttttgtcattggtgcctgaccgactattgccttctgcttatttgtcttttagggtcatgcttttattgtctctttgaaattgatcattgagtcctatgagtcctccttatgccttccacctccatttagttagctggtttttcttgcagtctctgggtcctttttgttgttgtttgttttgcatttattattattgttattcatacatttttgagacagggtcttactttgttgcccaggctggagtgcagtggtacagtcatggctcactgcagcctcaacctgctgggctcaagggatcctcccacctgagctttctgggtagctgggactataggcacatgccatcatgcctggctaattaacaaaatttttttttttgtagagatggggtcttgctgagttgtctacactggtcttgaggatcctggcctcaagtgatcctcttgccttggcctcatttattattatttttaattgacatgtaataattttacatattcatgtggtacagtgatatttccttacatgtatacgatgtataatgattaaatcaggataattggcaaatctgtcaccttgagcatttatttctttgtgttcagaacattcaaaatctgcttttctagctatttgaaaatatacaataaattgttattaattatagttcccccatagtgctgtagaatgctagaacttattcctcctattctggatccctttttttttttttttttttttttctgagacggggtcttgctctgtcgcccaggctcgagtgcagaggtgcgatctcggctcactgcaaactccgcctcctgggttcaagccattctcctgtttcagccttctgggtagctgggactacaggtgcccgacaccacgcccgactaattttgttgtatttttagtagagacagggtttcaccatgttagccaggatggtctcaatctcctgaccttgtgatctgcctgcctcggcctcctaaagtgctgggattacaggtgtgagccaccacgcccggtgttttttttttgttttgttttgttttttgagacagagtcttgctctgtcacccaggctgtagtgcggtggtgtgatcttggctcactgcaacctccgcctcccaggttcaagcgattcttctgcctcaacctcccgagtagctgggattacaggcatgtgccaccatgcccagctaatttttgtatttttagtagagatggggtttcaccatgttgtccaggctggtccgaactcctgacctcaggtgatccgcccacctcggcctcccaaagtgctgagattacaggcgtgagccactgcacccaccaaatctggatccttttgatcagacaaagtatattgtaaaacaaagtacgtgttgaaatctcaaagactcaatactaaaacctttgtaactgttacactttccttgcacaaaaactgacgtaaaatctcttaggtttcatagagagatactgaggaatgttccctatttccgtccacacagataggtaccaggatggtagtaaatgtaagtctgatccaactcataagtgctagcttgagatccttgattttatttattttatttattttttattttttttgagacagagtctggctctgttgaccagggtggagcacagtggcatgatctcagctcactgcaacttctgccttcgggttcaagcaattatcgtgcctcagcctcccgaatagctagaattacagatgtgctccaccatgcctggctaatttttttgtttgtttgttttttgtttgagtcaaagtcttgctcttgtctcccaggctggagtgcaatggcatgatctcgacttactgcaacctccgcctcccgggttcaagcaattctcctgcctcagcctcccaagtagctgggattacaggcacctgccatcatgcctggctaatttttgtatttttagtagagacagggtttcaccatattggccaggctggtctcgaactcctgacctcaggcgatctgcctcccttggcctcccaaagtgctgggattacaggtgtgaaccaccatgcccagcccatttcttttgtatttttaataaagatggggttttaccatgttggtcaggctggtcatgaactcctgatctcgagtgatccacctgccttggcctcccaaagtactaggattacaagtgtgagctgctctgcttgacctgagatcctttatttttatttttatttttatctttttaaggatttttccttaaagtatatgaaaccctgaaaacttgtacgactgtttaaaataaacatgttgatttcttcttcctaaagatgaatcacaattgagtcttatttgacctgaagttgttttcattctctctaaacagtaatttgaggaggtaatggcagtctgatgtctcaggctacatttgcacgctagtctttcaccctcagttgtcatgtgttaatgcatgttttgtaataactgggataaatacaaggaacctttgcttttgtttttatttttttcagtaacaaatacttttaagaaaacagatgattttgggtcatctaatgcaccagctgtcgacctagaccataagtttagatgcaaagttgtggactgtttaaaatttttccgcaaagccaaactgttgcactatcacatgaagtatttccatggaatggagaagtcactggagccagaagagagcccgggaaagaggcatgtccaaaccaggggcccttcagcttcagacaagcccagccaggagaccctgaccaggaagcgggtctctgccagttccccaagtaagtatcttcattcttcattgtgtcatggatggctcagttgcttggccacagtgcttgtgttttctgacacacaaagcaggcattaggtttgtctgttccagttgaatcccacaggactgaacatattaagtgatcctctgggctgtgccacggagctgtggccttcctacaggaagcaggaacacctaactgagaattaccttgaaaaatcgcttagcctctgaaggccttgctgcttccagtatgagtggggacagtcaagcaaagggaccttattcagaagccagcaggagaactcgtgctcagagcagcatgggtgccatcgtcccactctcccaaacctgtgcgttttccttgccagcagcacaaaagagcacgataaccaaaaggtgatatgtgattctactgctgggtccaaatgtgaatcctgtttcatcttaagtgcaactgaagatatttataatagcactgtttgttttgcatagaaaccataataggggttaccataaaatctcattttataacttattacagagaaccttttaggaaatatcttctaaagcttacagaaattgaaaaattacatgtttccaggggaatttcagaagaattaatggatttccaataaattatataatcttcccagctttttacttgctattgtaatatcactacctacttcttggcttagaggttttctattaaaatgtgtaggtcttaaatggtatatggaactcctaggacatctggcagtgttcccagtagagtatacaatcaggtttcaggacaggggcagagccatgcagactaaggtgaactctgaccctccgaggggtcaaccttcatttatgctgtcaagactttgtatgtgctgtattatccattaaaaatataatgtgaggccaggcacagtgtctcatgcctataattccagtgctttgggaggccaaggcaggaggatcacctgaggtcaggagttcgagaccagccttacttaacatggtgaaaccccgtctctactaaatatacaaaaaaattagccgggcttggtggtgcatgcctgtaatccgagctactctggaggttgaggcaggagaattgtttgaacccaggaggcagaggttgcagtgaaccgagatcatgccactgcactccagcctgggcgactgagtgagactccatctcaaaacaacaaccaaataagctagcataaactcatgcagattgtatggttctgcttatataaagttcaaaaatgagtaagaaaaataatctatggtatttgaggtcaggacagtagttacctttgggaggaggtgggtaggactggaaactgggcaggagggagtcttctagggctccgaaatgttctgtttcctgatctgcatggtggttatacaggtgtgttcatttatgaaaaagtattggtttatgtgtttatttgtgtgtacttttctgtgtatgttttatgcctcaataaaaagcatgcttaggcggacatagtggctcacacctgaaatcccagcactttgggaggtggatcgcctgaggtcaggagttcgagaccagcctggccaatatgatgaaaccccgtctctattaaaaatacaaaaattagccaggcgtggtggcaggtgcctgtaatcccagccactcaggaggctgaggcaggagaatcgcttgaacctaggaaacagaggttgcagtgagccaagatcgtgacactgcactccagcttggatgacagagcaaaactctgtctaaaaaaaaaaaaaaaaaaagtgtgcttaaaacatatacttggaaatggtaaaaatgcagtaagaatgtaagaaactgcagagagataccaagataaaggattgggctttttacttgaaataatgaatgtaattgagaggattttaatgtttgtttgtttccttttatctgacttacctccaaattaatctccttttcagtcccatggcactaatctaggtttcttctcttgccctggttgttgtggtcatttcttaatcagttttcctcccatcattctttactcactgtggttatccatcattttgccatcggatcgatctttaagagtacagacctgattatatcactctcttgctaaataatatgtaaggacagaatgatgcttctgcaaagcataagttttggagctgggcacatgggttgtgaatcccatctgttgcctcagtcactgttggactctcttcaggtctccagacctcactgtctctgagtgtaaacctgagttcttgtgattagtttgtgagctaatctttttaataagcctgtgtaaacctgagttcttgtgattagtttgtgagctaatctttttaataagcctgtttcaaggcctggtgtggggaagtggatttccttcttccccttgctttctagaatttcatccttctcatccagccatatgtggctgagttgggtacatttgtgtgagctctctagctggattctgagtgctgttggggaggaattatgttgagtcatcttgagtcactacagtatcccatgggctctgcagcactgtagaaacaaccagcactgaaggactggagattatgttgagtaaatggaggtcattgaggtgtcaggagccagtagaaatagcaggtgctggatatcgtaatggattgacatctgggcaggatgagggtacaacactggaagtagagtgcagcctaccccagacagcacaaagccaccagagttaggttgttccaaaggctaaggcttgacaggcaggaggccattgagggacccatggaagtcctgcttgcctgaccatcgtggtgtgtgctctctgtgctaggacatagtgcctctgcctctccctgttcatggtaattgtctgaggagggactttgctcagtataatgcacctgagcgtggggcaggtattcctggccagatgctgatctaccacctggctttgggattcttggttaactgtacttgcatgacttggtttatgttgagtaatatgtgtcagctcacctgagtttgaatacaggctctaccgcttgcttgctccaggaccttgggcagagaacttgcgaaacttcaattttcccatctgtgaaatagagataatagtactacctacctcataactttgttacactaaatgacccaaggggaaatgctttgtaaaatgtctggcctataataaactctgaatacacagtctctttatctcagtgaaagcatttacccaggcagtcagagatctgagttctgaactcagccaaccactgatgagctacaaaaccaatagacaagacattgccattttggtataattaagaagcctgagtgactgattttcttttcttttttctttttttttttttttgagtgattttcgtttcctttcctttcctttcctatcctttcttttttttttttttttttgagtaattgattttctactttcatgtctccctcttgggtctcatgcattatactgacctgggattttattctctctgttaatactgaaggatccttttcaatgggatttggaaatttcttggtgaattggagatttttgtttaccagtttttaaaaataaggcctgctgtatactcactagactagtagggttggacaattataaaatgctttaagggaaacaagagtcttttaaatccctatgctttaacttgttgccaaaaggttttttaagtccttatgttttaatttgtttaaagtggtcctttgtaaaattgatcaatttagcagcagaatgtgccacacagaccactcacccactgtttgatcatttctgtaccctctcagtgagggcacagtctgatcatttctgtaccctctcagtgagggcaggatttgtgcagccaggaaggaatgtacccccatccacatgtcaagtggacacagcctcctagacaacatggcgattacccaaatgtatctcccatgcctcattgctgatacgtttagcagttaccagaccgaaggaactagaccatccatcttgctgtgatccagatggaaaattgaaagcctggccaccagccctgactgtgccactaaccagcaagagcctcggtattatcatatgtggatggggctcagtagacatgttcagtgtttatcacgtagctggctatcaatgagagtgaacatagtagtgtatgctgaagattctgtagtgtggctgccttattctgctgcagctctccagaaggcacccctgttccaggcatcaccccttacctttctcccatcaaagccttgccccagtttgtcagggttttactggatacttgactaatctgataaccaaaaatttgaaagaatagaaccaacttaatagtattgtggtttcacctcaggcttctgagaatgctcttatcagggtggaatttcagacagtgtggggagttcagttggggagacgtttcactgggagacgtttcacagtgggactctgataccaggcagcctgtgttttagtttacaggcagtgtgaacttgacattctgcttaagtgaaaaacagaatattataggatttgtgctgcgtgataatagtaactgtaaaaaagtaccccctttatgctgaatgctctgatttttttttttttttttttttttttgagacagaatctcactctgttgcccagcctggagtgcagtggcgtgatcttggctcactgcaacctctgccttcggggttcaagcaattctcctgcctcagcctcccaaatagctggtattacaggcattcaccaccacacccagctaatttttgtatttttagtacagatggggttttgccatgttgtccaggctggtcttgaactcctggcctcaagtggtcccgaacttgggttctcatggatttctctgatggagattcctggggcttccagcaaaaccactgggactcgaaagtaccctgcagagatttcttggctttggactcctcaatatctgggttggtaaggttgggcagaagtagtagttctggtctgagagtccgtagactgatcttagtagcaacctgccactgttccctttgtgatctcaggcaggtctcttcacagatctgatttcttttctccttccttccttccttccttccttccttccttcctttcttttctttctttctctttctttttttttgtttgtttgagatgaagtttcactcttgttgcccaggctggagtgcaatagtgcgatcttggctcaccacaacctccgcctcccggattcaaatgattctcctgcctcagcctcccgagtagctgggattacaggcgtgcaccaccatgcctggctaattttgtatttttagtagagactgggcttctccgtgttggtcaggctggtctcaaactcccgacctcagatgatctgcctgccttggcctcccaaagtgctgggattacagagatgagccaccgtgcctggctgatctcctcatttctaaagtgatgatgtagagctaggtatgcatgagaccaggccctttcatgtggggagaaaagctcataaacaacgtgagaaagctaagttctgtgttaggaacatgtaaagtgctgtgggaacacagattcagattttgcctgtagggtaggagctggactgttgagaggagaaggtgacatttgagttaggccttgctgtgaattgaattgtgtcctgccttcctccctaaaattcatctgttgaagtcctaaccctcagtgtgatggtatttggcaataattaagtttaaatgatgtcatgaggttggggccttcatgatgggattagtggcattataggaagagatcagagctccccctatccccccatgtgaggatgtagcaagaagatggccatctgcaaactgggaagaggggcctcactgggaaccaaatagtctggcaccttgatcttgtagtttccaacctccagaactgtgagaaagaaatatctgttgtttaagccacatataacataatgttttgttataacagcctgagcagactaacccacgccttaaggagtgaggctagataggaattggaccagaagccgggaagaggaaaagcatccctgtgccaggaataggcatagcaagggttcagaggcatcaaggggaataaaccaatcatctgtccctaaggtgccccttctgatgccagccttctgtaatcctgtcactcatatggttcttctgctctcagccaagcctttagttgcaaaatgaatttagaaggtcagtttagatttgcttttccaaatgaggtttctcagtataccagagtcacttaataaattctcttccagtagccagctcaggctcccttgggtttctttctacttaggtgagttcagtcctgaatacaggttaggctcagaaagaattttctagtgtcaaagagggcctctcctgtgcttattattacttattgctacatctgtttgagtcgtgctctcaccctgggtaaacctcagttttaggccaaagtgagccttggggcactggagtgggcacctcttcattgccatccacaccttttctcatgggactacactggccttatcgcaggaacatgtcctcctccccttaaaacaaaaagagcagtgtgagcttaattagaatatggattatagtgccataacagagagaacaacatagctggctaaaatcagagaagtttatttccctctcaggatgaactgcaagttacccatggtggctgtgctcaggctctgaaggtccccgggccttgctttctccccattgttccaccaggctctaaaggtccctgggccttgctttctccccgtttttccaccaggatctgaaggtccctgggccttgctttctccccgttgttccaccaggctctgaaggttcctgggccttgctttctccccgttgttgccccaggtgctgctcttctttggtgtccaaaatggctccctgccttgcttatctttcagctgctgggaagggaagtgaagggaaagtatgctcctttcttttaaggcacaacccagaagtgccacacatcacttcttgtatccgataggcagaacatctgccacccctctctcaagggaacatggaacatgaactcttcctatggaagaagtggagaaatagtgttgggaagggcactgcagcctttaccacatgagctaagaagaatgcagggcttgaggagggaggggttattggagggccatcctgggttggtatctgggtgggactcatggtaggggactgataggagatgagattgggaaggtagacatggtgaaatgacagtggcagaccctgactaccacttctctgataggcagagagaacccctccaagcccatatctgcttctgtctgcccttgagctaccacccccttgtgcagatcagaacatgctctggtcagtgcttgtcccagcctcgtggctgagctctgtggtgtacaagcagttaccccataggtggtggtgatgctattcttttccctcctggaagcggcggtctgatgacagttgtccctctgctctcataaatcagtgactggatggaatactcaagagtcagctgtatggaggagcaagagggcctctggtatttctcctgatggacacctgcagcttggggagaggacaagtggccatcctggaggaaagcctcaccctgcttaggtgacaagctgctctctgatccagagcctggcaggaagtcactctttgtccaacctagtcagggcagccgggaggaagctccacagccagtacatgctctgtgggtcatggaacaattggtaaagctgtccagagagagagttgacagcagaccagcgaccagcactgctttccagggaaagaatattgcaagcaagataataacagctgacatttgagtacttcatgtgctgggcgctgttccaagttcgttacttgtattgtcttatttagttatcagaacaaaccctctgaggtgggtgctgttatgcctaatttatgcagttattccactgtggtctcagagtgtggttgatatgatttcaatgatttgaattcactgatacttggtttatggccaagcatgtggtcaattttagattatttgccatttgcagatgggtggaatgtatagtttgtcattgctggatttaagtccagtatttctttgttttttgcctcgatgatctttctaatgctgtgtcagaggggtgttgaagtcccccactaaaattatgtgactaagtctttctttaggtctggaagtacttgttttaagaatttggatgctctaatgttggcatattaggcatctataatgcctaatttatagattagaaactaaggtgcagatgagatggattaatttgaaccaatatttacagctctagcaggtggtggagccatgatttgaatctgttgtgaagcccatactctcactttgaggctctgctgtcttttatgattccagggaagagtgcctgtcccaggccctggagtgggagataggagtgcctccctgcaggagacttcctgtgcacctggcagtctggggatttctgcctgttgtcaccttgtctactcctgttcctcagggactcacctgccttagctcagtccttgctgggcaattctctgtgtcttttctagggcctgcaagttctgccactggagtttacaaatgaccactatctttagccagataaccaggtatgccctagcattgggcagttttcctctacatcttgccctctctgtctcaaggatttaggacctagattatgttgctgcttcaggcagttctgctgctgacaagataaattctgttagcatttcactaagctgatgggtataattactttagttggaggtcactaaaacctgaatttacaaataaaaactggatcagggagcagtctgtgtgtgtgttgtggaggagtgtgggtgaaggtacaacagataatatccctcctttgctgagatccttccagtggctccctaaatcactcatagtaaaagccaacttcctcacagggcccttcatcatgttctgctgctagcctccatctgcttctttcccttactcaacctaattctaatttcagttccattggagccatacagatctccttgctatttctttatttcaaattccagttattcattgctggcatatagaaaagcaatagattgttgtatattaactttgtgtcttgtaaccttgctgtaagtgctgttctggcagtctttgttttgatcaattctttgggatattctacatagacagatcatctgcaaacaaagatagtgttatttcttccatttcaatctgtagagcttttatttccttttctggcttattccactcgctaagatttccagtaaaatgttgaataggagtagagagagaggcaccttgctttgttcctgatcttaaggggaaagcatccaatttcttaccattaagtatgaagttggctgcaaagaagttctttatccagttgaggaaattccctcctattcatagtttgctgccccatcagctttttaggttggtgcaaaagtaattgtggtttttgctgtgactttcagtggcaaaaacagcaattcttttgcaccaactgaatagaatgtagctctgtgagggacagggggtgttatctgtctttgttcattgcaatatccctcctccctagaatgtgcctggaacatagtatatgcatggtatctgttgcctaaatgaattgaaaccatggctaataatacggtggtagtcaaactgtgtaaaaatgagttttgtttttatgtttggggaagaccctgttctcaggatcaatgaaaagtaaaaatgactgatagcttttttgaaattcagaaggcatctgaccatgttttgccagtctgctgtctttgggccttgggtttttggttttaaaaatgagtgcttttacaaattggtctaagttctctccagctttcatgtttgttgactttctttctagttgcagggtattttaaaagttaaggagctcaaatacccttaagtcctatgttctctagccagtagatcaactctgcctatagattccaggcttgccagccagtaggcacagcccactcttcctttctgatggttaccaagtgctaatttgggagaggggcctgggttgcagaggagacatggtgctggagagtcagaccaatttgcttttaaatacctatgtgatgtcaggtgggtgatttcacctctctgagcttcagtttcccggcctgtaaaatgggaatgatatacacacaagttgttgtaaggattaaatgagatatttgtggtttccttgcacacaagtgcttagttaaaatggaatctgattgtctaccctgcctcacacctgctttgtggatatcttgattccatatcagaatcacttggaaagttttaaaaatcctgatatccttgaaaacatcatgctaaatgaaagaaaccagacacaaaaggtcacatattgtatggttccatatttatgagatatccagagtagataagcccatggagtcagatgcaggttggtggggctgaggggaagggcttaggggaggggaaatgctgcttaatggtaaagggttttactttggagtgatggaaatgttcttagaactatatcaaagtggtcgtacaacattgtgaatgtactaaatgcaactgaattggttgtttttctttacagctgtatcgagacttaattgtacaatgaactacacatatttaaatggtataattggtgagatttgacatatgtttatacccaactatcaccacaatcaagatagtaaacatattccattccctcccaaactttcctcatgcccctttttagttcctccttcccacctctcccctccccctgagctccaggcaaccactattctgcttactgttacttgtggtgtgttttctctcttttttcttcccccccgagatggagtcgctgtgttgcccaggctggagtgaagtggcacgatctcaactcactacaacctctgcctcctgggctcaagcgattctcctgcctcagcctcccaagtagctgggattacaggcatgagccaccacacccagctaatttttgtatttttagtacagatggggttttatcgtattggtcatgctggtcttgaactcctgaccccagctgatctgcctaccttggcctcccaaagtgctgggagtgagccagcatgcccagatggtttgttttcattttgcagactattgtagaaatggaatcctgcagtgcgcacttgttttgtctggctcctttcacccagcatactttgagattcacttatgttgctgttcgtacctttttttctatttttattttttgagacggagtcttgcactgtcgcccaggctggagtgcagtggccagacctcagctcactgcaagctccgcctcctgggttcacgccattctcctgcctcagcctccccagtagctgggactacaggcgcccgctaccacgcccggctaattttttctgtatttttagtagagacagggttttaccatgttagccaggatggtctcaatctcctgacctcgtgatccgcccgccttggcctcccaaagtgctgggattaccggcatgagccactgcgcccggcctgctgttcctacctttattgctgaaaagtcttccattgtgtggatacatcatgaattatttgtacattcacttgatggacatttgggcagttttcagtttggggcgattacaactaaaactgctatgagtcttcatgtataagtctctatgtggacgtaagtgatgctttctcttgaatgaatatgttgtagtggatggcaaggtcataggatatatgtacgtataaactcttgttgatatctaaaaagtaaggcatggtgaattacttgaaatcctataaatatatttggtaagagaagaagaaacgactggatttttttgtttgtttgttttggagacagattcccactctgtcacccaggctggagtgcaatggtgcgatctgggctcactgcaacctccgcctccccgattcgagcaattcttctgcctcagcctcccaagtagctgggattacaggcatctgccaccacgcctgactaatttttatatttttagtagagacggggttttgccatgtgggccaggctgatctcaagctcctgacctcaggtgattcacctgccttggcctcccaaagtgctgggattacaggcatgagccaccgtgcccggctacgactgaatttttctttctttcttttttttttttttctttgagatggagtctcgctctgtcgccaggctggagtgcaatgacatgatctcggctcactgcagcctccgcctcccgtgttcaagcgattctcctgcctcagcctcctgagtagctgggattacaggcacacaccaccagacccagctaatttttgtatttttagagagacggggtttcaccatgttggtcaggctggtcttgaactcctgaccttgtgatctgcccgcctgggcctcccaaagtgctgggattacaggcgtgagccaccgcacccagcaatgactggatttttcaatggtgaagctattaattttgaaaactgatctcagtagagtggtaggtgggaagctttttagaatgtaattaggaaaaactgtgaagggagaagtttggacagggaggattgacatcttaaggagttttgttgtagagtagagaggataaagttttggtatttagaaggcatgaactgttcatttaaaaataattttatgttatatgaatggtacctcaatttttagaaaaagaatgaaacaagcaacagaatcctggctggatgcggtggctcacacctataatcccagcactttgggaagctgaggcggctggatcacctgaggtcaggagttcaagaccagcctggccgaaatagtgaaaccccatctctactaaaaatacaaaatttagccaggtgtggtggcgtgtgtctgtagtcccagctactctggaggctgaggcaggagaatcgcttgaacccgggaggcggaggttgcagtgagctgagatcgcgccactgcactccagcctgggtgacatggcgatgaaaacaacaaaaatcagatccccaggtgattccagtatgtagccagggttgaggagcagtgatctaagtagagttttgcaaacttgtctgtaaagggccagataataaatacttttcaaccttggggttgaaaggtctctgtcctcacttttcagctctgctgttgaagtgtgaaagacacgtaaccaatgaacatggcatgtttcactaaaatccatttacaatgacgggccatgggccagagtgtgctgagctggactgaaaggctaagtgatggaggcgtggctctgcctccagactggagcaatctgctccagacttcccaggcagagccagacccatcggacatgcttgcttaggagaagaataagcaccccagcattgaaaacaaaatgttaaaatgccaacatttgtgtttaattctagctacaaaagacaaggaaaagaataaagagaagaaattcaaggagtttgtgagagtgaagccaaagaagaaaaagaaaaagaaaaagaaaaccaaacctggtaattttttttcctgagggtttcacttaggtttccttactatgaatggggaggggttgctttctcccattatggcctctgggcctgcgctgagcagaggaaggaccaatagtctcttaccagggcttgtgggctcaacctagtatgggccctggaaggggaggcatccactcacccaggtgttacaaagtcctgctggcattgaaaagccttctcacttgctgccttggccagtgtgccctgctgcaggatggtacagatgaaggcatcgaagtgtaagcagatgtgcaggtgaatgatggtatttgttcacacacacgactcttaaaacacatctttgagccctcttgagaaaggattcccttcttaaaaactgtgtctagccctcacaaaaatgtttagaaaaatctatatattctgacttgggacttaaaggatgccacgttttattcttggtgtatcttctagcttagaaaaacaatcttatcagaaaaagaggagagggtcaatacttaagaggaggtgtttgggccccttcatctgctctccacacctctttttggttgaattgtccctgagcctttgtgctgcttgaaaaggaggcttgttggttggatgagattgattctagaatgcaccagtgttaactagggttattcattccttcctgatcctgttcttccagaatgcccctgcagtgaggagatcagtgacacctcccaggaaccttctccacccaaggcatttgctgttaccaggtgtgggtcctcacacaagccaggggtccatatgagcccgcagcttcatggcccagaatctggacaccacaaagggaaagtgaaagcattgggtaaggaggctcttctgtcctgatcatttgctgatcatttattggaaaatacaagcatacctgggagatattatgggtttggttctaggccactacaataaaacaaataaagctagtcagacataatttttattttcccagtgtttacaaaacttatgtttatactatattgtagtctcttaagtgttcagtagcatatgtctaaaacaatgcatataccttaattggaaaatattgttgtgttgagaaatgtcaagttttttggagtaagtcctcaaaagcatagacaataaataaagaaatggacaagtgggattgcatcaagctgaaaagcttatgcacagcaaactaaacgattaatagaatgaaccgaaaacctactgaatgaaagaaaatatttgtaaactattcatcaacaagagattagtagctggaatatataagaactcaactcaatagaaaaattattcaatgtaaaaattggtggccaggcgcggtggctcacacttgtaatccctacactttgtgaggtgaggcaggtgggtcacttgagcccagaagtttgagaccagcctggccaacatggtgaaacccatctctgcaaaaatacaaaaacttagccaggcgtggtggtgtctgccttgtaatcccagctactcgggaggttgaggcaggagaatcgtttgaatctgggaggcagaggttgcagcgagccaagatcatgccacttcactccagcctgggtgacaaagccagactccgtctcaaaaaaaaaaaaaaaacagtaaaatatgttatatatatacatatacatatatatatgtatatatgtaaaaaaaaaggtaaaatgttttatatatatatatatagatatacacacacttacacacatatatatatgtgctcaacctaatatgggccctggaagggaggcacccactcacccaggtgttacaaagtcctgctggcattgaaaagccttctcacttgctgcattggccagtgtgtcctgctacaggatggtacatatgaaggcattgaagtgtaagtggatgtgcaggtgaatgatggtatttgttcacacacacgactcttaaaacatatctttgagccctcttgagaaagggtttatatatataatttatattttaaaatatatatatatattttgttttgttttgttttgttttgctttgtttttgtttttgagacagagtctcactctgttgcccaggctggagtgcagtggcgcgatcttggctcactgcaacctctgcctcctggattcaagcaattctcctgtctcaacctcccaagttgctgggattacaggtgtacgccaccacgcctggctaatttttgtatttttagtatacacagggtttcaccatgttggtcaggctggtcttgaactcctgaccttgtgatccacccacttcgacctcccaaagtgctgggattacaggcatgagccaccgtgcctggactgttacatttcttaaaactttctttgaaataaaattagtttagttattccatatgtcctgaaaaatgtgacatatgtgttcattagatcaatcttgttttgatgtaatgttcaaaaatttgaactagcaatacatttcattatgttaactgacaatttaaaaaatgaaagctgggtgcaatgtcccacacctgtaatcccaacactctgggaggctgaggcgggtggattgcttgaccccagaagttcaagaccagcctgggcaacatggcaaaccttgcctctacaaaaaatacaaaaaaagttagccggttgttgtggcatgcacctgtaatctcagctacttaggaggctcaggtgggaggaacacctcagcccaggaggtcaaggctgcagtgagctgtgatcatgccactgcactctgggagaaagaatgagaccctgtctcaaaaataagtaaataaaataaaaataataaaaagtaaaacaatattttattgcttaaaaatgctgacagacacaaagtatttgcttttgcaataatggtgtcagtagactttcagggttgctgccacacaccttcaatttgtaaaataatatacaatatctgtgaagtgcaataaaatattaatagttatgcctgacttagaacagtatctgcttcagaacaagcgcttagtaaaagttagctgtgattataactaatcaggcatcaagtgattctgcctctgattatccctggaatcttcctcttcctcattcctcactgtctatagagtttttgtttttgatttttgtttttgagacggagtctcactctgtcacccaggctggagtgcagtggcgtgatcttggctcactgcaacctctgcctcctgggttcaagtgattctcctgcctcagcctccccatagctgggattacaggcgcacaccaccacacctagctaatttttttgtatttttagtagagacagggtttcaccacgttggccaggctggtctcaaatcctaggctcaagtgatcggcccaccttggcctcctaaagtgctgggattacaggcgtgagccactgtgcccagcctgtttgtcttttgagacaaagtctcacgctgtcacccaggatggagtgcagtggtgtgatcatagctcactgcagcctcaaactcgcaggctcaagggatcctcctgcctcagcctcctcagtagctgggactgtagacgtgcatcaccgtgcccagctaattttttttttcttttagtggagatggggttttgccatgttgcccaggcttgacttgaactcttgagtgcaagcaatcctcctccttcggcctcccaaaatgctggtattagaggcatgaaccaccatgctcagcctttgtttacagagttttaaaggtagctctggatacagacagactgtaagccaggtcctgactggatggagtgaggctgaagaacatgttagagttgtcagggatggtggcctgtgtggttcatggggagttgtagctcctctgccactgagttctatgatcttgagtagccactgccgttgggcttcattctctcagtgaaatgaggaagtggagttgagttcactgccaggcagcatgcttcgtttgggctgttactaaatgacagatccaaggacagattggcatcctcgtttccttgccctatgaatgttcttgtttggaggtatgggactataatgtcatttttcattcttgacaatcaaaggttttttaattttataacctaaaatagtaactgttgttttccctttcctcgtagaggaggataatttgagtgagtcctcttctgagagctttctctggagtgatgatgagtatggccaagatgtggatgtgaccaccaacccagatgaggaacttgatggggatgaccgctatgacttcgaggtggtccgctgcatctgtgaggtccaggaggaaaatgacttcatgattcaggtaggcagagcttccaggaaacaggtctagagaagcacaaactggtccttggagggaattttgaggccagcaacaatggcaagtcatagcagagccccagaaacacagcacgaacggcagcagactgagcttctctttttcgtttggcttcctcagagttccaggctgccatacatagtccattgatggagtaagagaggactttagggatcactgagtctaaacctctcatgctctgcttgaggcagctgggacccgcaaatgggaagggccttgcctgtggtcacaaagtgaggagttgaacagcagggactgaaatctttggagtggcagtttaatcttcccatggactcttatcttctctttgaggtaaattttctttaagatccaaagtcatgcaggctggctttataacttctatgtttctttttctttattttcctgacatttgagtctgtcatcttcatctctgagatgtgcctgtggtgggtgggacctccttacctgcttggggaaaccatgcctggccagcacctgcctgccctgtcccttgtctgtaaattgcagttctgggagaggtggcgctggctggctggctcctaagggtgtcacaagttccctgggtgtcttgacagctgcccaactggcttgggaagctgagtttttaaaagtcatggttatattggttaggatttttttttaggggcaagtacaaatattgttgggaaaatagactgggtcctagggctcagaggcagggctgctttcaggctcagaacctggaattccatcttgagggccttggtctgccttgtttcctgcttctctggagtccttttggttcttttttattttattccttgcttattttcttggaaaatgcaaaatggccacctttggcctcgccccaattttacatttttgtgttcaagaggctaggtagaccaaggtcagaatcttagtcccagttctaaatttctgagtaagtaattccagccaaatttagatcagatattagtttttggaacagtcacctgtggccagaggggaaagaggtttgttatggatcaaatgctctcccctggtctagttgtctgatctggtggtagtagagcttacagattatcgacaggggcaaaaagactgcctggggcccacctgtgttatattatagcgttaatgggggttcagggattgttcccagtaaagggggtggctgcccattgtccaataagaatctgtatagcctattgagattatgagaaacaggcccagcccctttggcttgctttctgtgatagaatattatttccttgccctttcagtactgtaggttggcatggcatgggtttggttttttttttctttttgagacggagttttgcacttgtttcccaggctggagtgcaatggcgcgatttcggctcaccaccaccctctgcctcccaggttcaagcgattcgcctgcctccactgcccgagtagctgggattacaggcatgtgctaccacgcccggctaatttttgtattttcagtagagaagcggtttctccatgttggtcaggcttgtctggaactcccgacctcaggtgatccacctgccttggcctcccaaagtattgggattacaggcgtgagccaccgcgcctggcaaaatatttttgttatggtaatttttttttttttttttttttgagacggagtctccctctgtcacccaggctggagtgcaatggcgcaatctcggctcactgcaacctctgcctcccgggttcaagcgattctcctgcctcagccccctgagtagctgggactataggcgcctgccaccatgcccggctaatttttgtatttttagtagagacggtgtttcaccatattggctaggctggtcttgaactcttgaccttgtgatctgcatggcatggatttttgaaattcacttttggatcttgacttaatatacagttacattttttcctctcatctttgaatttgttgtctttatactcaacaatcccctttccttttatttcttgaaacattgggacttttccgtagctctttaaactttcagaacaactagagatgagtagatgtatttgcttttttgccttttattttcccagggcttttagaaaacacttttattttgaaataattatagattcacaggagattgtaaagaggtgtacaggagagtcccatgaattcctctgctggtcttcctcccatggcaaaagcccataaacccacagtaggatatcaaaactacaaaaccatttgacattggcataatcactagagcttattcagattttatcagtgatatacacatactcatttgtgtgtgcatatagctctgtgtgctttcattacaagtacagccttgtgtaatcactcccgcaatcaaggtactgaggtatactaagaccatgagattccctcctggtacccatactttgtagccatacttatccctaaccctggaaacactaaactgtttcaactgtctataattatgtaatttatgattcttggttaatggaatcacgtggtatgtatctttttgagagaggccttttttactctgtataatatccttgagattcatccatgttgttgtgtgtttcagtagtcatttattcttattgtccggtagtattccatgctatggatgtaccacagtcgtgctctttttgttaatagaactaaagcaactctatggagctaaggtaactgggtacagctgagtagtgatttaaagtttctggagtgttttcagaaataccatctcacctctaacaaggcgatctcaagtcacttatttgggaaaacaaaattacgaagatatgatttctttcattgttgtagaaccattaaataagtcatcagattatgatttgaacccagggcacccagtcaagtgctctttccctatgcggccttagctacggggatttacatttacagttgagaagtgaaacaagaaaaatttgtttttgaaacataatagtaccatctagcctggctgaccaacccttccccagcaccaccagtggacatgcgcatgtacatacacacatacatacccacactttaggctgagggagagtcttgtctttttgaatagccttcatagtaacctctgggattcaagggtacctgatatttaagacctttattaaaccttggttcagtggttttcaaacatttttgaatatcagaaccccttttcctaatggactgtttcatagaaccccaaaatgtgtaacaggtaacagcaatagttttgaaagttcaaaatggataatctttacttgtgaggtcggacatgtgaatggtgggcatattcccatgattctaatatgctgtcagaattatgagtgacagacagttgctgacttggagcacttcagtggctcatttgtttttctctatttggttatacaacagtgagacaagcgtgatgcacatggccattgtcagggtgacttttcctgaacagcatgctgtgtagttactttgattaatcagagatgggaggacaagctccgttttgaggtcaacataatactgagctatcctagcaatacaaaattatgtgtggtggcgggcttcattgtcttaacatatggcttggaacatgtttgagtgtgcatctttttttttttaattgtcctaccttaaaaacacacacattttgcagactctctgaagccctgtggactactattagataattgttggttgggcatgctgtaatcccagaattttgggaggcagaggcgggaggattgcttgagcccaggagttcgagaccagccctggaaacatagcaagatcctacctctacaaaaaaattaaaaaattagctgggcatggtgatgcatgccagcagacccaactactccagagactgaagtaggatgatcacttgagcctgggagttcaaggctgcagcgagccctggttattctgttgcactccagcctgggtgacagaatgagaccctgtccccaccctcccccccaaaaaaaagaaaagaaaaaaaatgttatataacatgaagactatcattttttagtagattttttttaagtttgtttttaaaaggatgttgaagatctttagtttctactctgtcatccttgagcatatgctcagttccaggccttgttagtctgacagatttgccctttatctgcctgttaaaatcttcagtgggtgagtaatgaatgtccctcctggcagggctattctgtctaacagtatgtaacccatttctgatccactctggtactttctctattgacttttctataagtagcaaggatcttggtgtgtttgagggtagaggttaatatgccattatgtgctatatgaagaaactaatttcggggcaattggggccaccatgagcatggcagagtcaggagccaacttgatctcctgcttcccaggctccacaagaccttgtgtctcaagctcacttcagagcttcttggcttttgttccagaggacttttctgtgctgtccacctgaaccaagagtgcccacctggctttgtgttaaggagggacggtttctgactgtcctgtcactgtgagcaacgtaccttttctactcaataactttatcaaaaggcataagtttagagggagctagctagaacaaatacagtttaaacttttaaaatgtattcaccatctaattaggaagacaggaataaatttttcttaaatctttaccttaaattgatattttgaataaccctagaatacatttagagtgtgttttctagaagtgcatgtattactatagagaaataactttttggatcattgtcattatatgagtagtatcaacattgttcatgtatatcactattttatcttatttaccagtgctaatttaaatcactggaaggttaaaatcctacttaataaatacggtatttgagaaatctggctaccacataaaaatgaacaggaaatacatttgatatttaaattattttaatcgctgtagagcatgttttgttaagctttttcttaaatggctagataataaatttttaggttttgagggccatatggccttgttgcacctactggattcttctttgagcagctgtaggcaatatgtaaaacaaattttcacctgtatggttggctgcagtggctcacatctgtaatactagcactttgggaggctgaggtgggcagatcactttaggccaggagttcaagaccagcctgggcaacgtggcaaaccctgtctctacaaaaaatacaaaaattagttaattgtgatggtgcacacttgtagtcccagcttctcaggaggctgaggtgggtggatcacttaagcctgggcagtcaaggctgcagggagatgagattgtaccactgcactacaacctgttcaatagagtgagaccctgtctcaaaaaacaaacaaacaaaaacccctaaacaaatgcgtatggctgtgttcacataatactttatttacaaaacaagtcaagctggcattggcacatgggctgtagtttgctgacctttgccctacaacaacaagtattaatatgtattaagtgtccaactccagtaaagattttatagcagttttaaaaagaagcccattttaatggcctagcactgtggctcacacccgtaatcctagcactttggaaggctgaagcggaaggatcacttgagtccaggagttcaaaaccagcttgggcaacatagagagaccccgtttctacaagaaattaaataaaaattaagtaaataaaaatttaaacaaagaagcccatttgaaagttttggttattttaaaattcatattatttgttggtacctaatgcactgacataattcaaagtccagaaagcacacagagaaataccttatccccaccttatccccaactacccattccgtagagtcagcccttatcagtttcttgtatatccttccagaaacattctatggctaaacaaacaatagcaaatgtattgtttccttttaaaaattttttggtaaaatacacataacattaaaagttaccctttttatttttatattttcctattttgagacaggatcttgctttgtcacccaggatggagtacagaggcacaatcacagctcatggcagcctccagctcctgggctcaagtgattgttccacctcagccttctaagtagctgagactacatgcacacaacatcacaccttgctaatttctttaatttttttttgtagagatggaatcttgctatgtttttcaggctggtctcaaactcctggcctcaaatgacccttcctcctcagcctcccaaagtgctaggattacaggtgtgagccaccctgccctgcctaaaagttaccattataaccatttttaagtatgcaagtcagtgatgttaagtacattcacattgctttgcaaccatctctttgtctaaatgcaaatgtttgcattttatgtatagtattttcttttcttttcttttcttttttttttttttttgcgatggagttttgctcttgtcgcccaggctggggtagtgcaatggtgtgatctcggctcactacaacctccacctcccaggttcaagtgattctcctgcctcagcctcccgagtagctgggattacaggcatgcaccaccacgcttggctaattttgtatttttagtagaggcagggtttctccatgttggtcaggctggtcttgaattcccgacctcaggtgatccgcccacctcggcctcccaaagttctggaattacaggcataaaccactgtgcctggccgcatgtatagtatttttaacatcttttttcatttagcaatatgtaaattaaaaaccattttattttctgcataatggttggatcacattttattttactttattttattttatttttttgacggagattcgctctgtcacccaggctggagtgcagtggcatgatcttggttcactgcaaccttcctctcctgggttcaagtgatcctcctgcctcagcctcctgagtagctgggactacaggtgtgtaccaccacacctggctaattttttgtattgttagtagagatgaggtctcaccatgttggccaggctgacctcaggtgaccaactcctgacttcaggatatcctcccgcctcggcctcccaaagtgcggggattatagacaagagccactgcgcctggcccatttttcttttttttaagctatataaatatttgatccacctgaaattttgccaggtatatagtgagaactatggctccccattgtactaataccatacctcactgtttgaaatgccacctttatttacttcatttctaaatgcatttgaatccttttctggttctctctttcagcgattcatctgtctgtatatttgctcgtacaattctattttaattattgtacctttataatatttttaaaatatctggtatggctagtgtctccatattgctctttctttttcacacatttcccagctgttaattttagaattttttctagttctgaagctattaatttattattttattgagactttttttttttttttctgatatggaatctcgctctgttgcccaggctggagtgtagtagcgtgatcttggctcactgcaacctccgcctcctaggttcaagcaattttgaacctgcttcagcctcccaagtagctgagattacaggcgcctgccaccatgcctccctaatttttgtatttttagtggagatggggtttcaaacatgttggccaggctgatcttgaacttctgaccttaagtgatccccccgcctcggcctcccaaagtgctggctgggattacaggcatgagccactgtgcttggccgggactacattctttttataaattaacccaaggataattgatatccatatgttaactcttgctgtccaggaacagggtgcactgtacattgacttaagtctctgtgtgtgttcttcaaatagtatttacattttttttttttttagagaggcaatacatgcttatggttattcttaggtattttatcttttagtttgtttattattctcattcatttcttaatttaaaggaataatgtgttttagctacacgcacatggaaaaagttatcattggccaggcgcggtggctcatgcctataatcccagcactttgggaggccgaggcaggcggatcatgaggttatgagatcgagaccattctggctaacacggtaaaaccccatctctactaaaaatacaaaaaattagctgggcatggtggcatgtgcctatagtcccagctactcaggaggctgaggcaggagaatggcttgaacctgggaggcagaggttgcagtgagccgagattgtcccactgcactccagcctgggtgacagagtgagactccatctcaaaaaaaaaaaaaaaaaaaagttaccattttgaaactgaactgtatttgattcatttttggtgaatcctggttttcaaaacatgaagtcattggtgagacagactttcatttttttttttttttttttttttttgagacggagtctcgctctgtggcccaggtgggagtgcagtggcgcaatctcggctcactgcaagctccgcctcccaggttcacgccattctcctgcctcagcctcccgagtagctgggactacaggcgcccgccaccacgcccggctaattttttttgtatttttagtagagacggggtttcactgtgttagccaggatggtctcgatctcctgacctcgtgatccgcccgcctcggcctcccaaagtgctgggattacaagcgtgagccaccgcgcccggccgacagactttcatttttaattgttagtctgttttctgctactgaccgcctttttgtcactttacatatcttctctgagccttagtttcctcatctgtaaattgaagaatctaaaacagatatctaaagcctgtcttcccgctctgcccacattgattctgatgtgattaacttcctagaggccttatatctgctcagggaagccctcttgatgccaggacctatgtgactcccagtggttgaggaccatctgagctctggatttctagtcccttgtggccaggctggtgggccaccatcaaggtcatgtcaggaagctcactgtccaccttctagggctaatttgtttggttgggtagttaaaggtttagggtcctggtttggaattgcttgaagtgccctagtatctcctcgggagttcgcctttccttttcattccctcctctggacccttagctctcagacctactatcctcaggctgtccacatgtctcccagtgcaaccctcattgtcaactccctcctttccctctctgccttctggccctctccccctgtcccctcaatactcagggaaggaagtggagccttgggttgaaagaactggtttagcaacgagtcaggttatgttcttatccacctttgcctttcaatagctatgtgatctttggtaaggtttagagagaataaatgcaaagtactaacccatgattactccagcaggggtcttagtgaattggtttgctcattagtggttaatagtattaatagtagcttattacataaagctatgtgctgggctctgtaataggagcttttacatatgacccattgaatcttcacaaacagccccaggaggagggtaggaattgtgtatcccattttgcagatggggaaaataaagcccaggagaactaacctgtgcaaagtcacacagctaatgagtgtctgagccataattcaaactcagctttaagatgtcactcgtgggactgaggaactgaatttttagcttaccttgttaatttcaatgtagagccacatgtggctagtggctaccatactggacagtgcagttccagatgtgtggcagcagctcagttccacgttagtcaggagggagtgctccttcctcccctctccttctatcctcccatgcccctcccctcagcaggtgggtcttacttttggatggagaacaccttctgagtttaatttttgttgcttctttaattctaacagtgtgaagagtgccagtgctggcagcatggggtctgcatgggattactggaagaaaatgtgcccgagaaatacacctgttatgtttgccaagaccctccaggtagagatttctggagtcagggatataacagtatgtagccttttccttggcacagctggctgtgacacattctaaatgtctgcggtcttgagactcatttcttcagcatcggctagactccagctcctcctcgcctctgttgctatcctgccttgtggccagctatcctgaacgtagcaataagagcacacgtgtgaaggggcccacctagtggaaggcctggccttgagctagaacttttccttttctttaattatggtttaaaaaaaatgcatgaggccgggcgcagtggctcacgcctgtaatcccagcactttgggaggccaaggcgggtgaatcaactgagatcaggagttcgagaccagcctggccaatgtggtgaaactccatctctactaaaaatacaaaaattagctgggcatggtgacaggcgcctgtaaccccagctacttgggaggctgaggcaggagaatcacttgaacccaggtggcggaggttgcagtgagccgagatcatgccagtgcactccagccagggcaacaagagcgaaacttcgtctcaaaaaaaaaaaaaaaaaaaaaaaagcatgagatctaccctcaacaatacagtattgttgttaataactataagcacaatgtcgtacagcagatctccagaactttcatcctgcctgattgaagctgtgtagaaaaatgtagaaacttcacaagtttgagtgtcatccttgtgtaggggccatgctaatcttctctgtattgttcctgttttagtgtatgtgctgccgaagtggcaccttttccttttcttgaggactcatgaggatgggcgtgtgggctctgtctttggcttttgggggctattggagggttagaaacttgcctttgccccctgtggcaacatctgcccttcatcacatcactgccatcctgaagggagaaatgcccttgaggggaaggaggaaggcatggttgggtagagcctgttgccaccctgagcagtgacttaattccttagcaggatcagttagttccatggctataggggtcacctgtggctcttgattgctcctttctagaaggggtggattgtaaatatgcagttcattgtcttggtttccatgggatggtgacattgtctcccattaccacttgtaaggttctccctcagctctagtcccctgattcctttagagctagacagtgcttgagagcctctgcttccgttactcctttctgtccgataaggtgggcctggttctcctactcccagttttgcttatgaggaagaaattgatccttgaggatacagttgactttcctcataaagcaaattggaattagaactggtttgcagagccagatctcttgattttgttggttgtctagggagggactggccaccagttcatttaacagcatgcaggtcccctctgggcctgaaggcctctgttgtgacactgtctccttgtactagaagcatctgcctccacttgtccctttatcccaaggaaagaatagtcagaagatttgacaggtgaacaaacacaagtccagaagggacatgactggcccaagatcacgccaccagctaatgccagacaggcgatgagaaccagttgtctcatacctttgccttgtaaaacaggtagtgcagctctgaatcctgctgctctaggcactgcctgcagcagctgcctctggggttcccccatatattcctgaaggctccttagcataccttttaaaaatctttttttccctactgtgtctttctctctacttttccttctttagaagtcacacacaccatcttcatcaaatcctgtgcacttactgaacttctacgactttaatcgccaatactgtgaatagactcttccttgaactgagcacagcatgtctgccacagggtctacctttatagactgactctgcagagggctggaccaaaagtttaacagattcgttttttaaaggctacttaaaaatagttttaacagaatcaaggtgtatccccaccatgtgtattagtaaagccagaagtagctcaaagaccttaataggaatcacctgggtgtttcaaggtttttatagatattgacagtcgaacaacagtctggtagaaagcttttccctgggactttggagcaggtcatgttgataagtcacatgtgcttttgttttcagtccttcctaaggagccctgtaacaaataggatggctgaagccatccagttcctatgttgttctaatgaatggataacaggtacagagaagggaaggggcctgatcatctgttgagttaggtggtagaaggtacatttgcagggggacttgaggcatctttccattcatttgataagtccattcaagatgccttttgccaggcactggggatacaaccatgaacaagatagttcctactctttcggctcttaattgggttgggagccagaaacagaagttaaaacaagttaagtaaacaagactgtgtaaggtagtgatgaatgccgtgacgggaaaattgataagacgacttgaggcactgatgatgctctcaactttgggaagtagcagaaggccccactcctgggcaacatggcaaaaccccatcaaaaaaaaatgaaagaaagaaagaaaaattagccaggcatggtggtgcacacctgtagtcccagatactcgggaggctgaggtgggaggatcacctgagcccagggaggctgaggctgcagtgagccatgatcatgccactgcactgtagcctgggcaacagagtgagaccctgccaacaaagcaggaaaaaaataaaagcctttctgaggaggtggtaaggagccaaccctgcaaaggcttagggaatagtgctgcagacagaagggatgcgcaagtgaaggtcttgaggctggaaagagtttgatgtgtttcagaaactgaaatgaggccagtgtaaaggtatggaggggaagacaggaaggaactgggtcctgtgggcctcagtaagccagagttagagagttggggctttgggtattctcctttgagcagtaggaggcagtggaaggttttaagtaggggagagaatattatgatataaatttggagataatctaggtgcccagctcacctctggccagttccaggaaatgaggaagtacatgccttattcactaccttatccccactacctaatagagagcccagcatatggtaggtgccaagaaaatgtacactggatgaataaatgaacaaaatgagtatactaatctgttcttccagtagttggtatgataattgtgtgagagtgatgaaatggcctgggtttccttcaggccttgttttaaccctcttgttgtcactgctgtaggtcagaggcctggcttcaagtactggtatgacaaggagtggctgagcaggggacatatgcatggcctggcatttctagaagagaactactcccatcagaatgccaagaagatcgtggccacccaccagcttcttggtgatgtgcagagagtgattgaggttctgcatggcctgcagctcaagatgagcatcttgcagtaagtgtggcacctgcagtgctgggagcagtctgtttggcatggtctgggggctgagtaaatctgagaaattggaaagctaccaaagcaatcaaatcataaaactgagtttgagacctttactaaaaattatcagtttcaggataaacattctttaaaaaaaaaaaaactttattgagtaatatcttacatataattaggttcatccactttaagagttcattgaggccgggcatggtggctcatgcctgtaatcccagcactttgggaggccgaggtaggcggatcatgaggtaaggagttcgagaccagcctgaccaacatggtgaaaccctgtctctactgaaattacaaaaattagctaggcgtgctggtgtgcgcctgtaatctcagctacttgggaggctgaggcgggagcatcgcttgaacccgggaggcggaggttgtggtgagctgagatcgtgccattgcactccagcctgggcaataagagcgaaactccgtctcaaaaaaaaaaagagttcattgaattttgacattgtatgcagccgtgaagccaccaccagaatcaatacatggtgtgtgtattttggtttgttttttgttttggcatacagttctgagtgtttttttttttttttgagatggagtctcactctgtcacccaggctggagtgcagtggtgagatcatggctcactgcagcctccacctcctgggttcaagcgattctcccacttcagcctcccaagtagttgggactacaggcgcatgccaccatgcctggctaattttttgtgttttctgtagatatagggttttaccatgttggccaggctggtcttgaactcctgacctcaagtgatccacccacctcgggctcccaaagtgctgggattacaggcacgagccactgtacctggctgagttatttgtttttaattgctgtaagatatacataatataaaatttaccatcttaaccattttttttttttttttttttgagacagagtctcgctctgtcgcccaggctggagtgcagtggtgtgatctcggctcactgcaacttctgcctcccagattcaagtgattctcctgcctcagcctcctgagtagctgggaatacaggcgcacgccaccacacccggctaatttttgtatttttagtagagacagggtttcaccatgttggccaggctggccttaaactcctgacctcaggtgatccacccacctcggcctccgaaatttctgggattacaggtgtgagccactgcacccggccccatcttaaccatttttaagtgtacagctctgcacagttgtcattcatgttgttttacaaccagtctctaaaacccttgtgaaactgaagttctataccctttaccaacagctctccatttccctttccccaaagcccctgacaaccagtattctactttctgcctctctgaatttgacttctctagagacctcatgtaagtggagtcatatagtgtttgtctttttgtgactggcttatttcacttagcatagtgtcctcaaagttcatccgtgttatagcatatgtaagaatttcctccctttttaaggctgagtaataacttgttttatgtgtatgccacattttgtttatccctttcatgctaaatattccttttttttttttttaacaagagatggagtcttgctttatttcccaggctgaagtgcagtggctactcacaggtgcgatcatcaagcactgcagcctcaagctcctgggctcaagcaactcagctcattcttttttttttttttctgagacagagcctcgctctgtcacccaggctggagtgcagtggcgtgatcttggctcactgctacctccacctcctgggttcaagcgattctcctgccttaaactcctgagttgctaggattacaggcacatgccaccacacctggataatttttttttttttttgagaccgagtctcgctctgtcacccaggctggagtccagtggcatgatcttggcttactgcaagctctgcctcctgggttcacgccattctcctgcctcagcctcccgagtagctgggactacaggcgcctgccaccacgcccggctaatttttttgtatttttagtagatacagtgtttcaccgtgttagccaggatggtctcgatctactgaccttgcgatccacctgcctcagcctcccaaagtgctgagattacaggcatgagccactgcgcctggcctaatttttgtatttttagtagagatggggtttcaccatgttggccaggctggtctcgagctcctggcctcaactgatctgcccatctcggcctcccaaagtgctgtgataacaggcgtgggccactgtgcccggtcggtctcttggctgttataacctaccctactttaccaaatacagcaacagggccttgagtggggtaggcctcttccatggtttccatgggtggagcctggactagaatccaaatcctggctctgtcaggtacttttcgaactgtctctctatgtgatactgcatgaccttgtgagctttcttttggttttagtatagtctgtgtcagggactgcttttatttaagttgtaaacagtggcagactagtgcgatgagtgagttaagacttgataggctgctcctggataggatttcctttgtgctgatcaggcctagaggaggcctggtgtcaggcagagtggagtatcaggaccctgagatggtgagatgggaatctgcttcctcttgtgctctctggcacacagaggcctggcttcaagatctgcgtgacaaaggtggtggaggagggaacattgggtctgcgttggtttgggtaaaagctgaggtgctataacaaggaccccccacatagaggctcaaacaaaacagaagtttctttctcatataaatgaatggttcaaggctaggcagggatctaggctaggtaggagacctttctccaggattccatccgttgggttgggaactttgtttccttctgtcttacggctccagcattctcttagggttccccttatctgcatggtcttaggttccttttgtcttattgctctggcattctcttgggataccccccatttgcatggttgaagcagtttcacctgcatttcagctctaccccagtccccaggagggggaaaagagagaaagaagagggagggcaaatagtttcatggacaggcctaatggcagggcaggctgggcaggtggccacaggccctgcttatacttagaagtaggggtgggggtggggataaaaggaggagaggttggatgctggggcaattagcagttgctgtggcagaatctgttgaggtgaactgaaccaaatgacggccctggataggatgtcagagactagctatttcctcacatttcataaaacaggaaaacgtaaccccatgtaaaccaaatgaatttgtttttaatgagatggcagcaattaaatgaagtaggtggatggtggtccacgtgagtgcctgggaaacctcaggggctgctcctgattgtaaacttagctatatttctttaaaaaaaaattttttttttttaagagatggagtctttctgtgttgcccaggctggtcaagtgatctacctgccttgccctcccaaagtgctggggttataggtgtaagccactgtgtctggctcatatttcttttatttttattattttcttctcgacagtcttaatagggctgaactttttaaaaataataattgttatcctcccacctcagcctcctgagtagctgggactataggcgcctgcatttcttttcatttgagggttctgtcagatgctgttctcttttttcttacagaaatgccagtgttcctggccctggcccatattctgaagccttgccctttctttttttatgtttttgagacaagggtctcactctgtcacccaggctggagtgcagtggtatgatcgcggctcactacaacttctgcctcccgagttcaagcgattcttatgcctcagcctccccagtagctgggattgcaggcatgtaccaccgcacctggctagttttcatatttttagtagagactgggttttgccatgttgcccagggtggtctcgaactcctgggctcaagtgctttgtctgcctcggcctcctaaagtgctgggattacaggcatgagccactgtgcctagccccttgtcccttctgaatcctcatctagatcctccatctttagagaaattactttgtttgtagtagaattaaatctgtcttctagcaattcagaagagggcataggaagatcttggtacttcttacaaatggagaaaagatcctgggaaaggggaaggtggccccagtatgtctctgtattcatggatggtctctgttgtcatgggctctgggtctttattctcagaaatattgttccccagtgacctggtgaatttattttcgaagacaaacaataaaactgggagtaacttcagagcatctgtcatcataaaaaacatggcctggatggctgtgcttaccttcttcatgactgacagggcttacaaggaaatggcagggtcatgcttgcgagaagtagcaccttcagatcgcagttggaaggatgaaaattgtaggtgggaggaagcagagactttaatggtttttttaataaagagcaggtctgtactatggttcgtgtgttccatgttaacaggtagtggacctgaaagttaacaatgactcccatttcccctgagcagttttagtggtgtgtctgggtcctgggtaggctcctgggacaggctgataccctgtctggaggtatcccaaacaattgatgccaattgtttcccctcttccttagtggctagcagtggtatgggattgctggagtgggagagctgagacgggatagttgcaggcccttgggagcagaattttagttctgtaacatcgctctatgccttcatgtatatgaccacttccactttcacaggaaggtacaggaaggcatccacagcattttatgtgcacatacatggaggcacagctttcagtagatgctcacaggagtctggccctaaaaaggataagaatccctgttcttttctttaataacaaacttttttctttggaatggtgcgaataaattttcagaataatttttagaagctttatcattaatgacctatacataaaggacagttgattttatttttttaacccctgggtaatcattgcatttttgtaatcaaatgccattacatgctgggatcattgtgactgtttattaataagttaaggttatttttagtaagtcacatttgaagagcactttaccaccattaattcacttaattgttatgaaactcagtgtttgatggtgttggcaaaaagagtcaaattctgtaaaatacttgaagatatttattctgagccaaatatgaggaccttgacttgtgagacaccctcaggaagtcctgagaacatgagcccaaggtggtcaggctacatacagcttggtctcacacattttagggagacataagacatcaatacatataagaagtacattggctgggtccagaaaggcagaccaacttgaggggtgggtgggcttccaggtcataggtagattcaaagattttctgattggcaattggttgaaagagttaagttattatctaaagagtcaagttattatctaaaggccagtcgccaggcttggtggctcacgcctttgggctcccagcactttgggaggtcgaggtgggcggatcacctgaggttgggagttcgagaccagcctgaccaacatgtagaaactccatctctactaaaaatacaaaattagctgggcatggtgacgcatgcctgtaatcccagccacttgggaggctgaggagggagaatcgcttgaacctgggaggtggaggttgtggtgagccgagatcgcaccattgcactccagcctgggcaacaagagcgaaactccgtctcaaaaaaaaaaaaaagaaagaaagaaaggagtgtctgggttaaaataaggggttgtggagaccaaggttcttaccatgtagatgaagcctccaggtagcaggcttcagagagaatagattgtaaatgtttcttatcagacctaaaaaggtgccagactcttccttaattttctcctggatcaggaaaggacctggaaaggaaaggaggttctctatagaatgtagatttccccacaagagacagcttccagggctagttcaaaatatgtcaaagaaatatattttggggtaaaatactttgatttctttcagtacctgctatctgttatgttggtatcttaattgctacagtctgttttgtcagtctgagggtctctattttaatgttttgttgttgttgttgttttgttttgttttgttttttgagacggagtcttgctgtcgcccaggctggagtgcagtggcgcaatcttggctcactgcaagctctgcctcctgggttcacggcattctcctgcctcagcctcccaagtagctgggacaacaggcacccgccaccacgtccagctaattttttttgtattttagtagaggcggggtttcaccgtgttagccaggatggtctcgatctcctgacctcgtgatcctcctgcctcggcctcccaaagtgctgggattacaggtgtgagccaccgcccccggcccgttttaatgttaatgctggtcagttgtgcatgaattccaaagggagaagggtataatgtggcttgtctgactcccttcccatcatggcctgaactagtgtttcagtttaatgttggaatgctcttggccaagaggaggggtccattcaggttggttgaggggcttagaattttatttttggtttacaatagcagacagatcagacagataattagcccagtttcacagaggaggaagtaggaatgatgctggttgagtgagttgtcccagagttgaaatccagtcaggtcttctgactgagagtccagtcccactcactgtgtgtgaccacagtgggagctcactaaggagtggtctcctaggagaccacggattcacattcgctcttgtttagcaaatggtagtgtgtggtcagatggcccaggtggagctgctgtccctactgggagagtatttaggaattgagaacccctgcaatggtgccagttactccaaagcccatgtcctctttgtcctctcaacagaagccgggagcatcctgatctgccgctgtggtgccagccttggaaacagcactcaggggaggggagatctcatttcagaaacatccctgtcactgacaccaggagcaaggaggaagctccaagctatagaactttgaacggggcagtggagaagcccaggcccctggccctgcccctgccgcgttctgtggaggaatcctatatcaccagtgagcattgctaccagaagccccgcgcctattaccctgccgtggagcagaagctggtggtggagacgaggggctctgccctcgacgatgcggtcaaccccctccatgagaacggcgatgattccctttccccgcgcctgggctggcctctagaccaagacaggagcaagggggacagtgaccccaaacccggctccccaaaggtatgtggctgccttgtacttgttcttcattcattgcgtgaatgcttgcaagttatcctcctagtttgaatgctctatggaagatatttattaataaaactgtatttaaatttgcttaccatagatatgttttggtttgccaaaatgggtgcaaagtcaggagagcccacttaagccaaagatccttggttccaggaagcacccacaaaatggcatagtcaagtgtggcacgtggggtggggggcgcgggtgcagagggagggagaggtgggaagtagcaaggagatatggattagcaaaactcatcttttctttaaggcagtttgcattataattgcacctagatgttaattcttagcatgagcaaacaatgagtcaaatgttttgttaggcagaattttttcaatccagttgtatgatagctttattttgacttttaactttgaagccctgtggtaaaaatggtacactttgtcaaaatattgctggtttcatcagttttcccaagagccacttttggttttttgttattcaagtcattctcttctagaacccccttgtatcacctcgttgccggtgttttcatctctaactgctcactaggctcattgtgccctgtcctcagttgtcagtgaggctttgtatgatttgagagtttctctgtctcatcatccttacttcccagactttctcctgcaggttggtgtcaccagtgttaaatacattgctgcatggtgccaaggggatcctagattacaagcccctcaagggaggggattgtatctcatgcatccttgtgcccttgactatgtctaaacggtgttgggcaaggtggtaagaacacagtcttttgagacagacgcagtttcaattctgagctcagccccttactgtgtgattctgagcgggttacttcactttcctgatcagacctgttttctcgcctgtagaatggggccagtgaagccccctcagttactgtggaacatatttgtgaaaatccctcagtaaaatccctcagttttgcacatagtaagtactaaataaatattggctagaatctatttcatttcaaatggatgaatgaaaggttgagttaccaaatcctagaaaaggtttgtggtcctgtggatcaggcaggtttcctagaggtatctggcacataaaacaaagccaggaaatactgggcctcagcaaagcaaccagggctaacagtcttttccattgatggtaagctgactgtaagctggccttgcttttatgtgccttaccctatttcatcctcatgaaccttccaaataggttttagtacccccatcctcccaccgagaaagcagaggctcagagacatgaagtagtccatccagactcgcacattcgcaggagatggagctgagacttgaaacgcgttggtgtgactcccgtgtactaacccttgtctgcactagccctgctctaatcacctctcagggctctggaagccattctgtgaggcttactttaggctaggacattggcccagtcagtaggaagcagctgtgggtcccctgagctagagtgctaccctgaggtagttggaattggtacagtgggcaagctcctgcccagttcctaagtgggaaataggaaagggaggtagggatttggagtattgaaactgcagctagtatttcaggtggctggaaatgctggctggttgaaaaatgggccaggggctatctccattcagtaatttccatgccattgcatccccaggtgaaggaatatgtctccaaaaaggccctaccagaagaagcccctgctcggaagctgctggacagaggtggagaggggctgctgagctcccagcaccagtggcagtttaacctgctgacccatgtggaatctcttcaggatgaagttacgcacaggatggactccattgagaaggagttggatggtagggctccttcattggccccctgtgcattggcatgcagtcgagcacccccagacgagctgctttctgaaccccccagtctgagtttacagggaccgctgtactctttgcttctcttcttttcagcctctccccacctccattctcccctcaggatggatgagccttacttttagtatttatcaggtgcaagatctgcatgatgttgggtcctgcctcacttgtctgatcccttctgtaaagttgagtatgcagagagagggcaactggcagtcctgcttgcaggaaatatgtgatctaagccaatctttacaaacaagttctgtgagaaattaaaattttgacttgagttttaggatatctgaggatttaatctgaaaaacctcttattccaatctttgataaaatctaaaatgaagctttctcctcgtaagccagtagagatttgagaatttgcctgagtcatttgtatagccctgagtattccttccagatattggtggttacggacaggcctggaggatcaaaccggtgatgatgaacatgatcaagttcagtctctctccaggaagttgacggttttggttgttgaaatattccctaattatttgttttcatgttgaaaatggagcccagttaaaaaagaaatgttgtttgaggattctgggtacagtctggctatgattttttactgtaactgggaatataaaacatacatgaaataactcaggagaaaatgccatctgttatacaagtgatgccatgaggtgtggccgggacacatgtggctgatgtcaatgcagaggaggagagtgctaataggagggcttcctaaaactcctgagactgaagttgagctttaaggagagtgatggtgtttcctactggagaggactcagggtggatgatctggctagactggaaaaagagttgccctgttggaggacagtgagagagacagcaagacctaggctgggtgtggtggctcacacctataatcccagtactttgggaggtcaaggtgggaggattgcttgaggccagcctgggcatcacagtctctacaaaaaaataaaaaactagccaagtgtaggggtgtagtcccagctacttgggaggctgaggcgggaggactgcttgagcccaggagttggaggctgcagtgagctgtgattatgtcacggtactccagcctgtgtaacacagaccctgtctctaaaaaaataaactaaaaaaaagggattgtaactgatgccactgtctgtgaaaaacatattattagagagctgaaggaggatataatgttagacaaaaaagtgtagctcttgagagaatggcagtaggagtggctctgtagtccctgaaaagaggattagcaccatggaaacagggtgaatgttcggttgttgccacagggaccttccctgagggagaagttaaagtctactcacatcttacttccttaatcctctcttcagccaggtttggcctctctagccctgccgaatgggcagtgtggcaaggatggtaggcctgaacccccttctttggcctcacagatgacctcttgtgtgtcttgctaattcagagccacatattctgtacatttctaagactctaggccctgagagagataacaagaaagcattaaaataaatgataaagcttaaagattttatttaggtaaacagacttttgcatagtatttaagattaatcaaaatccctttttatggaatcaactctttatttaaacaccaagataaactaagctttctttctttcttttttttttgagatggagtctcgctctgttgcccgggctggagtgcagtggtgccatctcagctcactgcaagctccgcctcccgggttcacgccattctcctgcctcagcctcccgcgtagctgggactacaggtgcccgccaccaggcccggctaattttttatatttttagtagagacagggtttcactgtgttagccaggatggtctcgatctcctgacctcatgatccgcccaccttggcctcccaaagtgctgggattatagacgtgagccaccgtacccagccctaaactaagctttcataaccaagttttaaaataggaatttggatgtaacattccttttttaaaaagccggcctgcttagctgggtgtggtggtgcacacgtataatcctagctacttgggaggctgaagcagcagaatctaggaggcggaggttgcagtgagctgagatcatatcactgcactccagactgggcaacagagtgagactcagtctgaaaataaaaaatttaaaaaaatttaaaagctgacctggcgtggtggctcacacttgtaatcccagtgctttgggaggccaaggagttcaaggttacagtgagctatgatcgtgtcactgtactccagcctgggtgacagagcaagaccccatttctttaaaaaaaaaaaaaaaaaagcctagtaagctattatatgaaatatatatatatatatgccattgttttacaattggccattatttaattatttatgtagttatatgaatagtactttatttatttatttatttatttatttttgagacggagtctcggtctgttgcccaggctggagtgcagtggcacgatctcggctcaccacaacctccacctcctggcttcaagcaattctcctgcttcagcctcccgagtagctgggattataggtgcacaccgccatgcctggctaatttttgtatttttaatagagacggggtttcactatgttggccaggctggtctcgatctcctgacctcatgatctgcctgcctcgggctcccaaagtgctgggattacaggtgtgagccactgcacccagcctgaacagtactttaaaactaaaagacaaaggatatttaatgaccatgaaaagtaaaaaagtcttttggcattagagagattattttcttaaataaaaaatgttgccttggtgagcagtggtctctatacacatgatcttagtgtatttgaacagaattttttcctctgtaaccttctgtcttgctagcaaccactatgctagttggaagctgttctgcatctttaaaagagacacttgggatggtgcagcacatggtatggagagggtggcctgctggatgctggggtccagaggagatgctgttgacttcccacagtcctggctttgttcttcagcctaacagacctagacagacagcttccatctcaggaactccacacactcctgttaaccaagctcaggcactactgagtggcttagactcttccagtctgagcgttggtgcgctttcacactgtgcatgcctcctgggccaccgtagtatcgggatgtctttggtgagcctggaactagatccaaggtagttagggtgaccttaagaggggcctctcagcaactgtaggatcatcttgcaaaagattgactgactctctttgctgttggagtgacccatccagtcctgactgccttttgtccatttatttatttttattttattttatttttttaagacggagtcttgctctttctcgcccaggctggagtacagtggcatgatctcggcttactgaagcctctgcctcccaggtttaagcgactcttccttcctcagcctcccaagtagcaggcagatgcctgccaccacacctggctgattttgtatttttaatagagatggggtttcaccatgttggccaggcttgtcttgaatttctgacctcaggtgatccacctcccttgacctcccaaggtgttgggattacaggcgtgcacgtccggcctctccatttattcttctgcctgtttgctgaacagtcccctgtctccttctagttttttttaaagacttactggtgttttgaaactggtcactatccagttttcttgctcagcaggccactagttcctctcacatgactgatcttttactaatggttttcaagcttaagtctgaggaggtggtcttatttttcttatttccaagtccttgtacttgctggaattaggaagagagagggttcctccttcttggaacccccaaataccaacaagaaatatgatggaggaggataaactacatagggcccagagcaatgggtagggcgctttgctggaccacacattccttctctcgctgtgtttgttgcaggcttgccacatttcagacacaggtgagtgttagggatatagtggcaagcaaggcagactcagcctttgccctcgtggaacttgatctagtgggagagacatatattaaacaaatcatcccattacctgtaatgacaaaccatagtaaatgctcaaaggagaacatgtgatatcatagcacctgtaacacaaggaccagattcagggtatagggttggggaaggcttccctaaagaatagctcacaagaaacagaggatttagaaaggtggagaggaaggtagggctgcatctgaggacaggagaggattgcgcagtaggttgcaggctgcttgatgaagaggtactgggtgggcctttcttttgctgcactccagggtccagaaggtgctcagtacaggttggtgcatggactagaaaggctacaggcaggctgggatagcacaggggctacctgcagggggtggttcttgtcaaaggtgcagggttcccagatggtctctccccaaatgccagagctttagggggtagcttagggaagaacaaacatctttctgtagagaaatacttgttctcacaagcaagacagctttctagatattgaaccaatgatgataatgttaattaatacctgaaatcttacattaaatatttaaaggggtcctgcatggtggttcatgcctgtaatcctagcactttcaaagtggccaaggcaggtggatcacctgaggtcaggagttcgaggccagcctggccaacatgatgaaaccccatctctactaaaaataacaaaaattagccaggcgtggtggtgtgtgcctgtaataccatctcctcaggaggctgaggcaggagaatcgcctgtacccgggaggcggaggttgcagtgagtcgagatcattgccattgtactccagcccaggcaacaagagcgaaactctgtctcaaaagaaaaaaaaaggccaggcccagtggctcatgcctgtaatcctagcagtttgggaggccgaggtgggtggatcacctgaggtcaggagtttgagaccaaaatacaaaaattcgccgggcgtggtggcacatgcctgtaatcccagctactttggaggctgaggcaggagaatcgcttgaacctaggaggcagagattacagtgagctgagatggcgccactgcactccagcctgggcgacacagtgagactccatctcaaaaaaataaataaataagtaaataaataaagggagaaaataataacagagtattctgtgccactgatgattgcgtatcaatcaggaattaatatgaagcaaatcagagtttatgatatacaaatagaccttttcaagaccctatagattttcatttttcttgacaggatgctaaaacaccaggctctctgattttcaacatgggaaagctttttattttttattttattttattttattttattttatttattttattttattttattttattattttatttattttattttttgagatggagtctcgctttgtcgccaggctggagtgcagtggcacgatctcggctcactgcgacctccgcctcccgggttcaagcaattctcctgcctcagcttcctgagtagctgggactacagacgggcaccaccatgcctggctaatttttgtatttttagtggagatggggtttcaccatgttggccaggatggtcttgatctcttgaccttgtgatctgcccgcctcgacctcccaaagtgctgggattataggcatgtgccaccgcgcccggctgggaaagctttttaaagagtgagtggtaacactcagaaaggtgcttccttccaagacttctagactctggtaacagtagcctctggcaatgtgtggctgtttaaccaaaactgaataaaatttaaaattcagttcctcagttgcattagccatgtttccagcgctcaatagctgcataaggctagtggctactgtattggatgacacagacttggaccattgatcatcgcagaaagttcttttggactgtgctgctctaaagcatttgtgttttgtcctgggagtaccactttgtagagcaggtgttgacacagtgctggctgaaatggcccttcctcccttgccccatggaggctgaaatggcccttcctcccttgccccatgtctgatggaataaggtgctgaaatgcttgctgatgttcttgcaaatcaagtgttgggagttcactaggtctcatctctctcttctgccgacagtgttggagagctggctggactacactggggaactggagccccctgagccgctggccaggcttccgcagctcaagcattgtatcaagcagctgctgatggacctgggcaaggtgcagcagatcgccctctgctgctcaacatgaaactgggcacccaaaactcatgggggcacaatcctggggcacctgcaggaggagcttcgcatatttaaataaataaacctagcatgctgaatgcacgtgacaccgactgacttcagggatctgggccaggagtgtggtggacattggacaaagaggccattttggctgcgggaggacactctgatctcgaagcctgccataaaggtagcaaatagactcttgggattcccctcttctgtgcacatcgttgaatgaagagagtctttttgcacaaacttcacttgaaattgtgccactgatgataaacggaatgagagccaaaaaagtttagttggagacagttgtaaattcaatttggagtttatttaattgacttttctatcacgttggggcacatgccaactccctggtttcttcctggcatggtgtttgggcagcaggcatcattttccttttctagcttcataggaatattgtgagctcaccatgctgtggaggttgggaaagagcagagtcttggctgccctgctttctccttaggactcttcacttttctcaccacatctcttgcatgacttcatggtactggggacaagtttgtatgccttcaccccagagctggctgggttatggcttttgtagcagagcccatacagcctatggaagaactagaatctcactcacagtaataagaatctaggaggaattccaaaccgaagcaggcagggtctggaacccaaaggacagcattttctacccacttcttaatattgacagcttccccgttctatttaatgtccaaaaatgtttcccaaaatttcaaactctttcactgtaaagatttgttacaaagaatgtggtttggggaattaccttattttatattgttgtaaacaaacttcaaattctacatgtgcgacttttctccttcctgaagggtgtttagtagtcagcgttttcagaattgttttgttactatactttaacattttacatttcctgtttgtattattttgtgagagcaaggtgatcatgctgcttaaggtccaggtacaacctatttgtaccttttgagacaatatttgtgttacttttgcaggttacggttccacatgtaattgctatattttgttttgtttttccttactaggcaaagttaaaatgttccatgctttgaggagtgacccatttcactactttgttttcttatcactaaaggcaaaaatcaaagcacagttgtccattaacacttataagttaattatgggtttatgagtctgtaatgttatatgctgcaaacatttactatgtaaacgtgaagtagccaataatatctcaatagtagtaacagtatctttagcgacctttggaatagttaagcacaggtcattgtggacatgaattcaggcctctgtactaaaatctatttcagggaatgttctgtctagtgatttgctcaccatttgatatataatgaattataggacaagtataagctgatctgctatagctgtccatcagagagaatacacgtggctataacatctataacaaaacgacgattcctctacaagaggctgtttctcactgctaacgttggtgtttctggcgtgggaagaaatgcacaggcgtgcatggcatgcacgttcagacagctgcattgtaagagttctgtcatgcagtctgaaaagggaagaaacaggatggctttctgtagccacacctgtgaggcgtgatgattgttgtattattagattactgatttttcttttctgaaaatacatttgagttttaatcacatctgtggaagctgtaacttttaaggtagtcaatttcatgtcttgttcaacgatgtaagcagaaactgaattgccctaattttgccaactggccattattgggattattgtttaaatttttggtaaaggaagtaatctcctttcattcattgtgacttttgttcttagggaagcagagaagactccccaagttcttataacctcattgtgcttccctaatttaaagccatgttgaggggctccattcccaattcctgggtcaaggtgaattaaccctatgttggagcactggaaaccgttatttgcaaacattgctgttaccatttagaaatatgtgcactatcagctgggtgcagtggctcacgtctgtaatcccagcactttgggaggccgaggcaggtggatcacctgaggtcaggagttcgagaccagcctggccaacagggtgaaaccccgtctctactaaaagtacaaaaattagctgggcgtggtggcggacgcctgtaatctcagctacttgggaggctgaagcaggagaggtgctggaacctgggaggcggaggttgaagtgagccgagattgcgctattgcactccagctcgggcgacaactgcaagactccatctcaaaaaaataaaaataaaagaaaagaaagaaatatgtgcactacctaagttttgtctttagaaaaactatccacctataaaaaattaccttgacaaaaatagttccggtttgactaatcattttgtttctttaagtggtaagtgtatgcaaggtggatccttgatgagccaacattgcactgtggatacatatctatgtttacgcgctattagaacagaaggcgctgtatatagaaatgttgctttgaagcaatatttgcaaaacacgcagacttctgtatctgtatttggaaaaaataaaacaggttcttgttgctatgtttcagttacgtattgttgagttacagtcatgcatcatataacgtttctgtcaaccatggaccccatatacagggtggtcccataagattataatggagctgaaaaattcccatcacctagtgatgtcctgatggtcctactgcataggcctaggctaatgcgtggatttgtcttagtgtttaacaaaaatctaaaaagtaaaatatatataaaaaatttaaactagaaaaaaactcatagaataaggatataaagaaaatatatttgtatagttgtaccatgtgtgtaaacacaaagtgttattacagaagtcaaagttaaaatttaaaagcttacaaagtataaaagttggtcaggcaaggtgcctcagatctgtaatcctagcacttagggaggctgaggatggagaccctgtctctaaataaaaggctgggtgccgtcgctcacgcttgtaaccccagcactttgggaggccaaggcggccagatcacctggggtcaggagttcaagaccagcctggcaaacatggcaaaaccccatctctactaagaatacaaaaattagcatggtggcgcatgcctgtagtcccagctacttgggaggctgaggcaggagaattgcttgaacccaggaggaggaggttgcagtgagtcgagatcgtaccactgcactctagcctgggcaacagagtgaaactgtctcaacaaaacaaaaaacaaaaacaaaaagttatggtgaactaaggctaatttattattgtagaaagaaaattaaaaaaaataagtttagtagttcgtgaccagcctgggcaacatggtgaaaccccatctctacaaaaattagccaggcatggtggcatgcacctgtattcctagctacttgggaggctgaggcaggaggatcacctaggcctgggagccagaagttgcagtgaacctagattgtgccactgtactccagcctgggcaacaaagtgagatcctctctcaaacaaaaaaaaattagtctatgtgttcagtgtttatataaattctggagtagcgtacagtaacgtcctacatcttcacattcactcaccacttacccagccagaacaatgtccagtcccgcaaactcttattttttacttttatatatatatatatatatgtgtgtgtgtgtgtatatgtatatatgcatatatatatgtgtatgtgtatatatgcatgtgtgtatatatacatatataaatatatataaatgtttttttttttttttgagatggagcctcaccgtgttgcctaggctggtgtgcaatggcgcgatctcagctcactgcaaccttcgcctcccaggttcaaacaattctcctccctcagcctcctgagtagctaggattacagttgcccgcaaccaagcccagataatttttgtattttgagtagagatggggtttcaccatgatggtcaggctagtctcaaactcctgacttcgtgatccgctcacctcggcctcccaaagtgctgggattacaggtgtgagccaccgcacccggcctattctatatttttacttaaccatttctatgtatagatacacaaatacttaccattgttactgcctatagtattcagtacagtaacatgctgtacaggcttgtagcctacgagcagtaggctctatcacaaagcctaggtgtgtgtaggctataccatctagtttgcataagtgcactctatgaggctcacacaataaaactgcctaagggctcattttcagaacgcatccccattaagagatgcatgactgtataaagttcttcaccattcttttttttttgagacggagtttcgctcttgttgcccaggctggagtgcaatggcgcgatcactgctcgctgcaacctccgcctcctggtttcaagcgattctcctgcctcagcctcccgaatagctgggattacaggcgtgcgccaccaagcccggctaattttgtatttttagtagaaagacagtttcaccatgttggtcaggctggtctcaaactcctgaccttaagtgatccgcccgccttggcttcccaaagtactgagattacagccatgtgccactacacccagataattttctatttttagtagagatgggggtttcactatgttggtcaagctggtctcgaactcctgatctcaagtgatccaccgcctctgcctcccacagtgctgggattacaggcgtgagccactgtgcttgtccttcttcacctattctaatcttctttaaacattaccttttaaagaaggctgttcttaccttctaaacaactatctttttccagggaggcaggtgcaaactctgccaagaaatcccaagaatgcaaaaatacttctcaatttgtctgtctttaatattcaaaagcaaattgcccctcaccaacttccagcccagtctcactcatgctttgtggtgtgaactgcaggctgattttgattgttgagagcagtgcaaggaagacaagtctggccttccttatattaacaaatggcactcactgcaataggacctatctgggaccaatccaagctgtccatggaccctaactagctccttcctggttgggcagaagcctctggaaacagagtaggtttaagatttcagaacaggtcctcattatttgccaaattctttcttccctttgtaaacgattatgctagtttaaacaccaaaagggagccagccggagagacattaaaatgagtagcttcagtaatgtaaataatccattacttcaactagttctgctttattcctaccacaggcctaaaatttggcaaggaagttgagcaagcctggcggcataagccagagctcacaagaactagcctatctctgtgaaggtgtgcagtaaacacttcacattaaaatggcccagtaacttggacattttgggaagcctgtacccaaagggcaggtgcaagttggtgcccatattggtatagaggtagccagttaagtgagcatttaatagagccagctattttgcgtgtaagaaacccaagtgggtccttgggagcccaggtgaaaaacttcccatgtgtggtagagggataacctaggttcagtcaacatctaaagatcccactatagccaacgaaggccttattgttacggactcccaacttcgtttcgccaccagccagaaaggcggtaggaaacaggcttggtaaaataaacccaataagaacgaatgaaagagacacaccagaccacaggcgctgccaaaactcatttttcattaacacggggtggggtcccaggctcaggcccccgggcccgatcatggccccagtccgcacagagcgcccggccctggccgcccgcagctccaccgctcagccagtgatgcgcacatccgtgcggcggcggatccgccgggcccgagccgcctcgggcaggatggcgagcagctgctcttgcaccagcatctccacgatctgctccttggtgcggatgtcaggccgcagccactggcgggacagctcccgcagctgccggaaagcctcccggggacccgccgcatcctggtagcggaactgccggaaacgctggcggaacgtctcgggaccgagtctagagccggcggggcctggtgtggagcgcgcttcagcttcggcctgaggcgctacgctcacgggtgcgggcccgagaggcagctccagggccgcggaggccgcagctcggggcgtagggatggcttcagggaccgcggcgttgggactggaaggctcaggggcaggcggtgaggcctctggcagcgaggagcccacacagttacgctcaggggctgagctcgaaccggctccttccagtttctccggtggcaccgccgcgggactcccagtggccgccaagatcggctccgtagccgccataactccagctccgggcgtcactctttgtccggtagctgtgtgctcagcactgcgtctgcgcgggggtggggtgagcagggagacgtttccggttaaagggcagagctcgcgtcacccttgagggagtcggactcgggaccggccgagagtgtgcggagcttacctgcaccagcgaagcgcctgcggcagccggaagcgaaagtctctggcttctctgcgtccaggtcggcgcgcgagcacccggaagccgcttgcgggctcccggaagcggcgccctctagcgttctcgagtcgcatgaggcggctgctgccctcgcggtgcgggagggcgagctgcgcgtggcctgggctccttccgaatggtggcgcctctgagcgccagttcgaggaggagtcggaggaggagcctgaatgtttggagatagacttcaagtcccggaccttatccgtgcgccgcttcggtttgcaggtgacctttgcgtgcgggcgccccttctgattgaccctgatgagctgtagctctgatggcccctccttcgggaatgattagggtgacggctggccggggctcgttcgagtggcgcccggccggtggtgacccgaacaggagagcgggacggcgaccattctctcgggaggggcccatctggagaaagtcctctcgcttggtcaaactaggagggcgatagcaccggccttactgcgacgatgacaaagtacaacacaccgtctggcgcgaaggagatgctcgagaaccctttgctgttgttatttttcgcgtgtcctccgaaaccaagggaaatgcggctctgtgggttctgttaacgtcagcatttaataagtgaactctaaatgcattgccccttatggtggccgctggcctcctgagttgactcagctcttgcaacgtagctagttgataaccctcgaaatatagcgaattgagatgtgctatattgtaaaatacgggacttagtacgaaaaaactgatgtaaaaattatctcaatactttttaatactgattacatgttggaatataatgttttgcatatattgggtcaaataaaaatgttattaatttcacctgtgtttttactttttaaatgcagcttctaaaaacatttaaattgcatgtgcagtttacattatatttctgttgagcagccttgggttagagtgttggagtgaggctaccttggtggaatcccctttgacgatacccagctcagagttgttaggaggattaaataaattaagccgttggagagaaagggcttttaagaagtttgctcttgtttttattaggtaaactgcttgctatctctgagctactgttttcttatcagtaaaatgtggatgtaatagaacttacctctcagaggtaattgagaattcagtgagatgatgtaggtaaaagcacgtggccctgacagccctcggccaggtggttttctgtttggtagctgactcacaaatagttttgtttttgtttttgtttttgttttgagactgagtcctccgcctaccgggttcaagcgattctcctccctccgcctcccgagtagctgggattacaggcgcccaccaccacacccggctaatattttatatttttggtacagatggagtttcaccgtgttggccagactggtctcgaactcttgacctcaggtgatccactctcctcagcctcccaaagtgctggcattacaggcgtgagccaccgtgccgggccacaaataggttttatatcctcattttacagaaggggaaactgaggccctcaaaggacaggggcctcatatgaaaggttttctatgaccttgcagtccttttgagcccgtgcaggatggaggagcaggtttaacaaccattaacatgccattagccctgatataaaacttacccctaccataggatgtttcctttggatgggtagaagtggaccctcatgaaatcatttccatagcctgaaaaccttgaaagtcgttgcagtgggcctttaatgttttttagttgctgacatgtaaaaattgggagatttcacatgcaaatctggatttctaatttttcttgaaaaaacggaagagctggccacactggacccaaattcctgctggtcaacaatcagctgacactgagtagagacgacttcctttagacaagatactctgtcccatttggtctcaatctcaaccattccctatggttctctgaaatagaatgttgtttgcatttactgttgctctcaggttgttgctttatttagagttgatatttttctctcttttctttttagaggtgagaaagcagggtcttagtgtttgttatgcctactggcttcaaaccttgacttctgtctggcccctcagtagttgggtttgctgcccagagtgaccaacagtgctattccctgtgtggtaacaggtactcagtttctaggcctaagggagcacactaacccttctgtggaggcaagaggtgatagaagtcttcactggggaggagacttcaagctgagactcaagaacaaaatgggtggggctcagggacattccaggtagaaggtactgcctgtacaaaggcacatagtgagtaggagcaaaactgtggaaactgcaggctatatgggaaagtggttgggatctggagaaggggtgagagatgaggttggaacactggtgggggttaaatcataaatgtcctagaattccatgtttaaaatttagttattatcttcttgtgaaagggaatgaacttttgtggcacctggaatcatgagatgttatgttagatctctagtctatttcttccatccctattgaaatcgtgaattattagagataggaggagggacctgagagatctattagaatcattgaatgtcagactggaagggcccttagaaatggaatttaaaaatccagccctttgtgggccggtaagcctgctttaaagtgattcagcagtaaaaaaataatgtggagggaataaatgaaacaagattggctcagtagttggccgggcgcggtggctcatgcctgtaatcccagcactttgggaggcataggcaggcggatcacctgagctcaggagttcaagaccagcctgggcaacatgatgaaaccctgtctctactaaaaatacaaaaaattagctgggctcggtggctcatgcctgtaatctcagcactttagaaggcttgaaagattggcagtatgtacactctactttggtatatgcttgaaaatgtccatgataaaagttaaaacattcagattcccagaatctgaaaaaaaacatataatgcctcttcttcgaaaagggatgcagttatctactttcatgtaatttacatatatccttgaaccctcccagaagtcccagattaagcttaaaatatacatttatatttcattcttttgaattttgcagattgagaaaccaagatgtcagaagatgaaggattggtccaaaataagaaagctagtaagtggtttcatgaggacagaaatcttttgacttttagtccaaactcttatcttattaggcctctttatccctagattgggagttcacttgggaagggatcataactcattcatctcatatcacttagcttccaacacaaggcctgactcctaggtagcttcagtgttgattaaaggaaagaggacaaatgtggattgcagaccatccctgagaaggcagagctctcatatgagtcccagactctttcagagacctcagtgccttttgatggcacttggttgttgagggttgtggaaaagaagcttggatacttattttcttttttatcagagccatcacactggagaatacgtcttttaaaaagcttttcattggccaagcatggtggctcatgcctgtaatcccagcactttgggaggccgaggcaggcggatcacgagttcaggagtttgagaccagcctggccaatatagtgaaatcccatatctactaaaaatacaaaaaattagctgggcatggtggcaggtacctgtaatccgagctacttgggaggctgaggcagaagaatcacttgaacccgggaggcagaggttgcagtgagctgagatcgtgccactgcactccagcctgggtgacagtgtgagacttcatctcaaaaaaataaataagttttttatttggaaataattatagattcatagaaggttgcaaaaatagttcagagaggtttcatgtacccttcagtcagttttccctaatggtaacatcttgcataactatagtacaatatcaaaaccaggaaattgacattggtacaatccacagactttattcacattttcccagttttacatacatgcatttgtgtgtgtgtgtgtgtgtgtaggtctatgcaattttatcgtgtgtggattaatgcaactactaccacaatatctagaactgtctgatcaccacagagatccctcgtgctatctctttataattgcatccattcatcttcccttcccctatccctaaccacaggcaaccactaatctattctccatgtctataactgtgttatttaaaaaatgttacatacctggaatcatatagtgtataatcatttgggcttggctctttccacttggcacaattccctggagattcacccaagtggttgcttgtatcaatagtttgtcctttttattgctgagtagtaatctatggtatagatgtaccatggtatatttaaccatccattgaaggacatttgggttgtctccacctttgagctgttacaaatagaactgctatgagttattttatgacatggctttgggtaatcacttatctttctgagcctggaaatagtaactaccacacaggatggttctgaatagtcgaggaggagaaatatatataagggaactggtgcagggtttggcacagaatatatacttcgtcatttttttaaaaccgatggttatgaagagataatacttccttgaatatgtaagttctagtatgtagtatttttaaaagtcacaggcattgatattattattagtgtattagtctgttctcatgctgctaataaagacatacccaagactgggtaatttataaaggaaagacgtttaatgaactcacagctccacgtggctagggaggcctcacaatcgtggtggaagacaaggaggagcaagtcacatcttacatggatggcagcaggcagacagaatgagaaagtgaaaggggtttccccttataaaaccatcagatctcgtgagacttattcactaccatgagaacagtatgggggaactacccccatgattgaattatcttccactgagtccttcccacaacacgtgggaattatgagagctacaattcaagatgagatttgggtgcggatacagccaaaccatatcattattgaacatctgtgtatgtgtgatactttatttacagatgagaaattaaggtctagagagattaattaacttgcccaggttcagccaatccatggcaagattgggattcaaacccacgtttaacatagacagtaggaaccatggaaggacttaaagcaggggaaggatgtgatcagatttgtgttttaggagactcagtctggatgcactgtaaagaatattgctttattgctgaacacttagattatttctgatttttcattaaaataatgtgataatcatatattgcttaaagcttgttctgattttgaattataagcatctattactatcaaatctatttggtctctgagtttgaaaaggaagcattctgatagcaagagcttggatggtaagggataccagtacttccttaagctgtaatcccaaaagaggactgactgaaatattttgctacatattgccacctttctttctatagacatgtgtttgattcatagaaccttaggacaacccctttacttcacagatgggcaaactaaagttcagaaagtagaagtactagccagggtagaatccagggcccagcaatgaatgagaattttagttgctctacatcctcatcagcacttagtatttcatttgacagagtctgtcatccaagctcagtgtcattagttattcagaaaattcagtgcagtgttgcagtcctagatcactgcagcgtcaaactcctgggttcaaactattctgcctcagctttgtgagtagctgggaccacaggcgcgtaccgccatgccccactaattgtttttttgtttgtttgtttgttttatagagacagggtctcgctatgttgcccaggctggcctcaaactgctgggcccaaacaatcctcctgccttagccacccaaagtgctgggattacaggcgtgagccaccgtgcctgcccctacctctcactttctctgtctctatactgccatactcctcttctcttcccttctcttcccttctcttcccttctcttcccttctcttcccttctcttcccttctcttcccttctcttcccttctcttccattctcttcccttctcttcccttctcttcccttcccttcccttcccttctcttcccttctcttcccctctcttcccttctcttcctttcctctcctctcctctcctctcccctcccctcccctttttctttcatcttgctctgtcgccacccccctcctcccgctttttctttcctctcgctctgtcacccagctggagtgtggtggcatgatcttggctcactgcaacctctgcctcccaggttcaagctattctcttgcctcagcctctcgagtagctgggattacagacgcctgccaccacacccggttaattttttgtatttttagtagagacagattttcaccatgttagccaggcttgtctccaacctctgacctcaggtgacccacctgcctcagcctcccaaagtgctgggatgacaggcgtgagccaccacgcccggcctcttggctctttttaaatcattcattcccaactccttcatttgctttttgcagtcctatcttctgttctcagcaaggctagctttctttttgatgtttctggaatgaccttctcttctgagatggttatttttaaaatcccttctttcctgagctctgccagtgtcgtctcctctggctgtctcagtgtcttttctttgaactattacatctttgctttgatctcttgttttaaaattcattaagccctttgacttctttgttgttcatgattatcatctgtttcatgttagcttttttatttttctttttttggtgattgtctttcatctgccatttgtttttcctgttccctgcctccctctcctgcttttttcagtaatatatttgtataagtcttgtgttatttcttttttactataactcccctttagatgaagtgagttcttctggacaagctgcttgtgggattgtgtgtggagaaaggactagagtagaattccaggctggcaggaattctcttggcttcatagtgaagcttcttctgacagggttttttgtgagtatgtgaattggtttagccctctcctcttccgatcagttggagcttggcagctgtagggctataaaaatggaacatctgtgtgtttccctggtcaccccactcccctacttctccttggtcccagtgggaccagagaggctcccagagccagcctgtccatcaccatcccaatgttctactgaaggtgttgtgagttgtgccctcaaggtgtagcccgcttctttggagaagtacgagttttgccagctctccctaaggcctgcagccatagcgttctctattggcattaaccttctggatcttctcagcacccctcattgccgcacaggctgatgtgatagcttgctactctcagcaccgtcaccctctggccactggagtgcttaacccagaaaggctgggaagttaatgcctccaggagcagctctcaagtggacaattctgaggcatgctccctgcagtctttttttttttttttttttgagacagagtcttgctctgtcgcccaggctggagtgcagtggcacgatctcggctcactgcaagctccatctcctgggttcacgccattctcctgcctcagcctcccgagtagctgggactacaggcgcccaccaccacgcccagctaattttttttgtatttttgatagagatggggtttcaccgtgttatccagggtggtctcaatctcctgaccttgtgatccgcctgtcttggactcccaaagtgctgggattacaggcgtgagccaccgcgcccggccccctgcagtcttactaaggtccccaggacattggagccccactgggccataggggtgacatgttcatgcacctctgtcaaaaaacaaaaatttatagaagatcctgtgattattctccttagctatgttaacataatgaattatgtttatataattaaccatctttgcactcccagaatgatatgttatttttacaggtactgctgaattctatttgcttatattttaagattttaagaacaatatttataaatgagatgaatctgtagctttctttttttgtgcaacctctattaggttttagtgtcagtgttctcagttcattacaataatttggtagttttccttctttttaggctctggaacggttgaagaaacattgaggttgtttggagttgcctgtgaaacctttaggaccagctgcttttttctttttaggtggtggtagtggtgagagacctcttttacagcttctctacttctatgacaattaatctatttaggctgggcgtggtggctcacatctctaatcccagcactttaagaggctgaagtgggaggactgcttgagcccaggagttcaagaccagcctgggcaacgtagtgagaccagatctctacaaattaaaaaattagtcagtcatggtggtgcacacctgtggtcccaactacttggaggctgaggtgagaggatcacctgagtctgggaaggtagaggctgcagtgagctgtgatcatgccactgcactctggcctagggcatagagtgagaccttgtctccaaattaaaaaaaaaaaaaaggaaataaaatcagaaaattagtctacttaaatggtttcggccggtcacggtggcggatcacttgaggtcaggagttcgagaccagcctggccaacatggtgaaaccctgtctttactaaaaatacaaaaattagccaggcacgatggtgggtgcctgtaatcccagctactcaggaggctgacgcaggagaatcgcttgaacccaggaggcagaggttgcagtaagccagggtcgtgccactgcactccagcctgggcaaaagagagactctgtctcaaaaataaataaataaataaataaatagtttctattggggtcactttggtaaattattttttcctaaaagattattcataaaaatctagtatttaagtgttaaaagactcattcaaattcctaaaaataacctctgttgaaacatgtcagtaggctagctatgggcggtgaactgccattttgcaaccactaaatagagaatttttgacctgaaagaggccctatggatccatactgggggttgcaaacaggtaacatgcctggcagatgacttaattgtgtgaggtgaagactttggtgaattacagagccaatacctcaactaaagacaagcaagttaattttgagcaatatttaaaccaaaacactatgcaggtcaaataaaacagtctgcaagttcacttggcacatcacgtgccatagctagtttatggcctctgccagcccagcctccttcctcataaccacacctcctgagcatctcacgttttagctatgtctcatgctccctgaacagaccctgctctttcttcatatatctttttttctttttttttttgagatggagttttgctcttgttgcccaggctggagtgcagtggtgtgatctcggctcaccacaacttccgcctcctgggttcaagcgattctcctgtctcggcctccctaatagctgggattacaggcccgcgccaccatgcccggctaattttgtatttttagtagagatggggtttctccatgttggtcaggttggtctcaaactcccaaccacagagtctatctctgtcacccaggctggaatgcagtggctcaatcttggctcactgcagcctctgcctcctgggttcaagtgattcacctgcctcagcctcccgagtagctgggactacaggcgcctgccaccacgcccggctattttttttttttgtatttttagtagagatggggtttcaccatgttagccaggatggtctcgatctcctgacctcgtgatccacccacctcagcctcccaaagtgctgggattataggcgtgagccactgcacccaaccacctcttcatatatcttttttttttaagagacggagtctcactctgttgccaggctggagtgcagtgccatgatctcgactcactgcaacctctgcctcccaggttcaaacaattctcctgcctcagcctcccaagtagctgggactacaggttcccgctataaagcccagctaatttttgtatttttagtagagacagggtttcatcatgttggccaggatgatctcaatctcttgacctcgtgatctgtccaccttggtctcccaaagtgctgggattacatacgtgagccaccatgcccggcctcatatatctttcatagctttattatagcaagactttctctgaggattttacttccccaccatattgtgaactcctggtaagcagggaccacatcttattcaccttcatatgctttgtaagcatttgttgtatagcttttataatcagcaaaacaataagaatcttctctctccctctctctctttttttttttttttttgagacggagtctcattctgtcacctaggcttgagtggtgcaatcttggctcactgcaacctgcgcctcccaggctcagatgatgctcccgcctcagcctcccgagtagctgggattacaggtgcatgccaccacactgggctagtttttgtatttttagtagatactgggtttcaccatgttggacgagctggccttgagctcctgacctcaggtgatccacccgcatcagcctcccaaagtgttgggattgcaggcatgagccaccgcgcttggccgaatcttctcataaattgtttgtggaattgaatcgaactccattttatacattatgaaaatgaggccccaagtagttaagtgacttacctaagatcacataggaataggaccagtgctctttttggcattctaccctgtaatagttacagttataaaatcaggaactgtaagagaaatgaaactttcttagtttctagaactgacttaaatgtgtgactctgaatccccagcccacctccttgcagataattgaatttaggatgtcttcaggtaaattgagatccaatccagtaattttgagtggatataatttcaggcttattgattcatcttgggcccattcatagctctccaaacttcctgcttcttcttccccaaagctgatctaattcctagagaaattgtacaaccacagctggcaagaggtgaggttggcagtaaacatttttggggtctcatcaggtcgtactggcatcatctgatgccccttgtgagcctggatactttccttgtcactcttggatcctcaggcagttcagaggactgacgggacacccttcctgcctatagccatctcctaccatctctcttgctttctccaggcccagttgtttctttcagaagccccctacacttttgaaggggatcctcttatatttccttccttaagactaggtttgcagtgggggaggcaaaaactccatacctcatctctctgtctctctttctaaaactttctcttctttctctctctgaattctttacatcttttctcatggtatgggggaaaaaccagttttgtcccttctcacctctgtgtgtgattactgtcccaccccaagagtggcctttgtctttcttctcagctgtccagccatctttgctgaactcagtgtccttctgtctacctatcagttggaggagagttaacagatataccccacgggataggaatggcagagcaggtgatgcttgaaatcacagttttctactgaggatcctggtgcaagagcaaattgagatactcaattgtcatctttaatagaaaaaagcactttagagcctatatttttctatatctttagaaggactccagagatttgagttctagtcaccaagttccattcaatatttgacacttgatttgggtgaggtcttctgttttgctgagttttttttttattgtcctgatttaaccagacttatgggacagtactatgcacccacgttccagggcctccaagttctaagtctcagagtggtccctgggctaaggtgctggatgaacctactcccagcctagaagcctcccgctgtaacaaagtacacccatttttctatgagatagagaatgagttatctttttaaatcatctttttcttctttctcttttgtgtttttcttctgttccccacttcctacttagctgattagaaatgcagttataaccttttgctttcccttcaccagacactcctagagcaagtgtatctgtgtgcttacttaaaagctccagagtagaaacctctcccaccagattgccttgagagacaatagtcaatttacaaccaaaagtatgcctgccaggaaactctgccccacctggagagtatctcgagacaaggccactttacaacctagttctgcccaagatggtggcagctcgaccaggcggtagataaggcaccaaagtgagtcatggagactcccacctgctcattccctcctctgcatgccatttatgccaattccccctcccgcttttttttttttttttttttttttttttgagacagagtcttgctctgtcgttcaggctggagtgcagtggcacaatcttggctgactgcaacctctgcctcccgggttcaagtgatcctcccacctcagcctcccgagtagctgggattataggtgcccaccacctcacccggctaatttttttgtatttttagtagggatggggtttcaccacattggccaggctggaccagaccttgcttctgttaattggatgctacaaatggagagcaagtgtacctgacatttagctacactgctttcttaaaaaaaaaaaaaaaaaaaaggccctggccaggagtggtggtttatgcctgtaatcccggcactttgggaggctgaggtgggtggatcacttgaggtcaggagcttgagaccagcctgggcaacgtggtgaaagcctgtctttactaaaaatacaaaaatcagccgggcatggtggcacacgcctgtaatcctagctacttgggcggctgaggcaggagaatcacttgaatttgggaggcagaggttgcagtgagctgagattgggccactgcactccatcctgggaacaaagtgagacagtgtctcaaaaaacaaaaaagccctatctttgcaggacaggtgagcccccaaattgagacttagcttaggagagttcttggctttgcccaaggaaggaattcaagggtgagccagtggtgttagacagcaatcttttattgaatagtgcttctccttgtggggcagggctaactcatgggcaatgaatccggagtcgatacccagtgtatgagatgttggcaactgtatttatgctcatctctaatcccttctcagccttttggctgagatcaagtgtagtatacgcattcctacccactttcaatcacatgcaaattaaggggcaggctaatgcaaattaaggggcaggttaatgcaaattaaggagtgggtttttagagttttctaggaaagaggtagcaacttcctggtcattgccaagacatttgtacactgtcatggcactggtaggagtgtcttatgttaatgagggatggggacagctagggggtcctagatcctgttttggtcagcagggttgtgccattctcctgtctcaccaggactctggcagccatttagctactttgagccccagtctcctatgtatggagttgagtaaaagtttgggtggttgtgaggattagctgagataatgcctgtgagtatcccataaatgttagactcccacattccaatccctgtgtcccctgcctccagaatctttcattgtgaccttaggagattctgagaatgatttttctcagagcagggcttccagtagctgatggtatggtaggaggagtggagtggagctcttgccttgttactgaggaaatctatttgtttctagtattactggatttttggggaaaaatttgtagtcctccccttgaaaggcaaaggggctagttgtgccatttgcctgcacaggaaccatgaggagacatatggtaacttatgcctggcagctcctgaagaaggaactggtgaggaggggcaagggccctgggagggaagagcagaagactgaacagacaggtgttttgaggaaggtcgatgcaggtgtaggaggggtcttggatgaatggtggccatcctgtaccttttggagtcacagcatggcacaaaggagggacccctgccctgtagcctaccagccccccacactgggcaagccataagccacactcagagccactgagtcctgttctgtacccactcttcctgctattatgagatccagagagaacgagggaggatagagtcagggtagcaacattgagtcataggttaagcttgtgaactctggagccagactacctaggtttaaatccctatcacctattagtcatgtgaccccaggcaagttgcttggtttgctgtgcctttattttctcctctgtaaagtgagatgataatactagtacctactgcataaatttactgattaaatgatttacatatcagaatagtgctttggataatgcctgacaatagtaaattgtactcagtaagtattaattttattcataaagtacctttccccatatttccatagatatctaatttttaagaaatagaacattacaggtgtagggaaagctctttaccatcccatgcccctttatttctctttaatagtaaccactttcctgaagttggtgtcacccttcctgtttatatttttatatattatcacatgtgtatgtatccataaacaatatatagtatgtggcacactgtttaaaaatgataccataaatagcatcatagttcttttttcccactcaaaatcatttcagctttatccacattgacacacacagacttagtgctgtgttcaatcctgtgactgaaccataatgtattgatcccttcgatccctactaatgaacatttgttttcagccattcactgttacacacaatgttgccatgattaccctcatggctatccccttgtacatgtatgtttctctgaagaggacatataaagtacatacaattcttccattgtgaagtacacacatcctcaactttatataatgttgccaaattgctcttcaacatggttgtaccatgtttcccagttcccagtgataagtgcaaaatagtatcatgttattactttaatttccatttccattatttctagcaatgttaaaaatggtttcacaatttggctggggcatgaaggctcatgcctgtaatcccagcactttgggaggctgaggtggaaggatcacttgaagccagagttggaaaccagcctgggcaacaaagtgaaaccccctctttacaaacaatgtaaatataaatacaaatgaataaaaacaatattttcacaatttataggtaatttgaactttccctttgaattacctttgctcattttgctattgggttatttgtatttttcttttgatttgtaggattacaaaaaataaattttggatcgtaatcctttgttgattatatgcatagtaagtatatttttccagtctgtagttcgttgtctcactttgtttatgatacactttaaaaagaacattctcttttttcctttgtttgtttttatttatttttttgagacagagtctcactctgttgcccaggctggagtgcagtggcgcaatttcagctcactgcaacctccacctcccaggttcaagtgctcctggtgcctcagcctcctgagtagctgggattacaggcgcccaccaccacgcccggctaatttttgttttttttagtgcagatgggatttcaccatgttggccagactagtctcaaactcctggtctcaagtgatcagcccaccttggcctcccaaagtgctaggattgcaggcatgagccattgtgccagagctgtttgtttgtttgtttgtttcattttgttgttgttgttacagggtcttgctctgttacccaggttggagtgcagtggcacgatcatagctcattgcaaccttgaactcctgggctcaagcaatccttctgcctcggcctcccgagtagctgggactacaggcgagtgccactgtgcctagctaacgatgtacttttcaatagaagttagtaaacagagacttttatttagtttttgcatttttttctttttctttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgtgttagccgggatggtctcgatctcctgacctcgtgatccgcccgcctcggcctcccaaagtgctgggtttacaggcatgagccaccgggcccagcctggctttatgtatttgtatatgtgtttgctgaattgtttgaaagtaagctgcatactttatgacatatctttcttaaaaataatgacattacccacataaccaaataccactatcatactaagaaaatcggcactgatttcctaatattatctaatgtacagtcatattcaatttccttatttgtccctagagtgcctttgctctgtcacccaggctgtagtgcagaggcgcgatctcagctcactgcaacctctgcctcccaggttcaagtgattctcctgcctcagcctcccgagtagctgggactacaggcaagcaccaccatgccaggctaatttttgtatttttaggagagaaggagtttcactgtgttggtcaggctggtctcaaactcctgacctcaggtgattcacccgccttggcctcccaaagtgctgggattacaggcgtgagccaccgcacctggcctagggtgccttttatagcttgttatcatgaaccaggatccaatcaagaagcataccattggtatgtctcttgaatctttattaatctagagcagcccccatgccttgtttttttcatcatgaaattgactttttgaagaaactaggttcattgatttatagattcttctacatcctggatttttccctatcttctgtattcacttgttctcagtctaattccaaattcctggggaaaaggtagggtggcccatcttggattaggtgttatataagttttctatggctgccataacaaattaccacaatttgatggcttaaaacaaagcaaatttattatattacagtactgtaggcaagaagtctgacatggatgttcttgttctaaaatcaaggtgtgagcattcctttctcaaggctcacggccttttctgcttctaaaggccacccacattccttggcttgtgggcccttccttcatcttgacagccagcagtgttgcattcctcttaccattattccctcagatctatctgattctaaaatccaggctctgtacatcatacctatactgcctgcaattagtcgtgccacttattttgtggatggaattgaaggatttgacatttagctggtttgctggtgcataacaactagcttctggggagagatgtcctgactagtagctgccaatttctatggcataagtactcctaccatggccagttttaagttaccaacttaatttcagcaggcttgcaaaattcctgaaaatgtaaccatcactccagcacactacagcacactactgcatttaatcctggtaaatttcaccttgttcagcaccatccagcctgctgttgactgttgagaacagatggtttctattgatcttgtttgctttgtttccatagggactgtaccagctcgccatggatatcatcataatgatccgagtgtgtaaaatgttccgccaaggcctcaggggattccgggaatatcaaatcattgagactgctcactggaagcaccctatcttctccttctgggatgtaagcagttgggctcagcaggattatgagggctcaaagaagcccaataaattgcatcccacttcctggcctaagctcagaactgagaaagaagacaaaaggaaaagcagatgagagacccaatggtcacttttattaatggccatacttctgttggagagggtgacttacatcatcaaccaagaggtttacctaatactgaaccccagatttagacagccttacatgcctagccacaggcaacgctggaccaaggcaggctccactgcaacagcaggcctgctgccaaaactcatggcagggaaaggtggagcaaaatatgggctgagagggaaggagacaatcatgcctagtttttctctttccaaattcatcaaagagtttaagtcactcctcaatgtaaaaggagagaggccagtagtgttctactaatacacctccctccatgtggaaagaaaccttgggagtagagaggtggtctccatttcaatggtgatcaaaagagccagaagcaatccaggaatcacaataaccagggttttctaaatgcccacacgctctctctattcgcgtctctactttctttcctacacccctacttcggtgcaggggcattttcagggctttgttcactgcggtgaccatgtttcttttatttttttgagacggagtcttgctctgttgcccaggctggagtgcagtggcgcgtcttggctcactgcaagctccacctcccgggttcacaccattctcctgcctcagcctccctagtagctgggactacaggcacccgccaccacacccagctaattttttgtatttttagtagagacggggtttcaccttgttagccaggatggtcttgatctcttgacctcgtgatccacctgcctcggcctcccaaagtgctgggattacaggcgtgagccaccgtgcctggcctggtgaccaggtttctagatttcctagaaggtcccaatttaaaatattttatcccagtggtagatcatgtgcccttctttagctcagaaaagttggtcacccttctgctaacttgttctagttccccagaggtatcttcattgctactgggtgtgttgctcagggcttcaaagtttccccagcaatcacctggacaaatcctgcccatttttctgttgtttcaggaatgactagagccagtccccactcctctgcatctagtgattcactccaagaaatttccctaaagggcttctgacagatagtggccaaagaaagggggatacggggctggtgatgggggaaggaaaggcagccttaaactggtttctgaggggccagcaggtaatataactagtgtgtatgtagctgagtttaagatacagcaggccagctggagaggaaagatacacctcatctaaagacattcagatacaaatattatattttaagaccctgtgctggccaaaccaaacaaggctgcagccctgtggttgggctgagatgaaaaacgaatggagtagaagaactgtaaccaaaagactcaggttagctctcaggaaggacctcctgactctcagggtggcatgtaatggtgatgcaatgggccctggagatcagagggctttggttaccagaagacgtggcctgatgcatggggcagttggaagctaagatgcagagtcacttgttgtcaggggaatgtgaggctaagcctaaccacattggccagccagagtggcttgagcagagcagaagcctctcaagggcagcctataagggtcatagggttgtcaggcggagcactgggcggctggagtgcaggatcaggtggggagccctagactgcttcagtagatgtgtgaatctggatgtttctgagcactgcctctttccttcagtagtctccctgagaagcaccacatggctatgcaaaggataaacacgttgtgggggcgagacgggtctgagtctaaggaacaaatgacatgtggcttgaggccacactccagacacggaattgggtttgctgaaagccttgagttggggtctcagctagaccactgacttgctgtgtgatccttgggcaagttccttcaccatctcagtcctacatggagcttaataaaacctgctttgtcctgatgactaaatggagtaaggcagggaggatacactgtgcttggctcattaaagacatttaacaaaggttggcttcatttgttcctttcttttttttattttttttatttttttttattttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggcctctttttttttattttttgagatggagtcttgctctgttgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccttgttagccaggatggtctcgatctcctgacctcgtgatccgcccaccttggcctcccaaagtgctgggattacaggcgtgagccaccgcgcccagcctgttcctttctttttattcttccttttcttcctcctctatgcttgtttgtttgctgcttttcccccttccttttctctctcctttcctgtttcctccttatcctcctttccttctccccacccccatatttctctgccttcacaataatatgctgtaaatgctggacccaagcctagtgctgagttggggccttcgagcagaggcaggcctgaaagggccggctgctatgaggtttcccatggcttcctgcccaccatggtggtccaggtagacaggagggctctagatgcaaagttctaggggcagtcttgctgattctccctcttctccctgccctctttctttcagaaaaagatgcaaagccgagtcacatttgataccatggacttcattgcagaggaggtatgcatagctcgaaacttgctgtgggggaattttctttctgcaccctggcttggaagaaaccctggctgggtatcagcagagctggtttcagtctaggctctgccaccaactcagcttgtcaccctgggttggccacttcgtttcctcatcaataaaatagctgatctcagtgattccttccagccctggagctccaagactgtgagcatgtaggaaccagctgtcactgcacagttgagcagaaccaatgggagagagttcctgggcttggacccgtgggaaaacagcaggaaaagataaagcagaggatgtgagagtcccagagagaggaagaattcaggtggtgggaaagggctgacctgtgtgaattctggttctaccctgaattctctgagagatgctgggcacacctctcacacctgggtgtcagatacccttaaagagtcttattcaggtgcagcgcagctgttgacactcggaaggctgaggtgggaggatcacttgaggccaggagttcaagactgcagtgagctatggtcgtatcactgcattccagtctgggtgatagagcgaggccccctctctaaaaaagagtcctctcattttgatgagagaatgcttttatatccatgggagctttggactgtgtgacttgttccctgaatttcaatctcatcattgttatcttcttggcttctctccatgatatcctggatattaaatattaaaatccaatttaaaatttaaaagagtctacctatttatagggaacatctgaaattctcaccaatgcagacctgacttgatcctggcttggagtagccacgttgttgtttttttcctcagtggaaggggaaagaaaagaactttataatgggtatcagggccacctgtgcccatctcctgccccacccctttctcttcttggagcccaggtatggcttctgttgcttgcctctcctgggcacagccttatttttcgtgccccctcgtgtatgaagcatactcagttaagtcattcaagctctgtgactcttcagctcttcaggctggctagtgtgtgacactgagcactgaagcttaatcaggctctttccttcaggcaggagaaactaggggcctatctgagagccacagaactctagatatgagggcaattctgtgcaccgcagtagagggcgggaagagggcacaaagggaaaattctttgttatgggcaaggcctataggtggtcctcaaatgaatcatgcctgactctggttccaacacagggaagagtagagagccaatttatcctcccgtctcagccttctgagtagctggcattacaggtgtgcgctgctgagcccagctggaggctcattttaaaaaccagccctttggccagatgtgctagctcacgcttgtaatctcagcactttgggaggccgaggcaggaagattacctgagctcaggagttttagaccagtctgagcaacatgtgagaccctgtctctactaaaaattaaaaaataaaaataattagctaggcacggtggctcacacctgtgatcccagaattttgggaggctgaggtgcgaggattgctggagcctgggaaatcgaggtcgcagtgagctatgactgtgccactgcactgcagtctgggtgacagagtgagaccctgtccccctgcccccaacccatcccaaaaaagcaagcccagccctctgagtgatgctaatgagtatagggtttctttggggtgatgaaaagcttccaaaacagtgtggtgattgttgtacaactctgtgaatacactaaaaaacactgaattgtacactttaaatggtgatttccagggcatgtgaattatatctaagtaaaaatgacatataatatatagtacacacacatgtatagttatataacctgcccctcagcacagcatttggattctgatggacaactaagcctcagtatagtccatattgggcttctaataacgctaaacttctcacagacaacccttagtattagagaggcttagaatcatagactcaattattgcagcaactgtcagacagtggaaacaatggatacatttacaaaacattgtttagaaaaacactgagtgaagaaaagcaaattgtgcaagtgatgtctacagtcttgacatttatgtaaattttttatttttagtttttgagacagagtcttgctgtgtcatccaggctgaagtgcagtgatgcaatcacagctcactgcaacctcaacctccttgggctcaagcggtcctcccattttagtgccccccagtagctaggactgcaagtgtgtgccactacgcctggctaattttttttttttttttttgagacggagtcgagctctgtctcccaggctggtgtgtagtggagcgatctgggctcactacaagctctgcctcccgggttcacgccattctcttgcctcagcctcctgagtagctggaactaaaggcgcctgccaccacgccctgctaattttttgtatttttagtagagacggggtttcaccgtgttagccagggtagtcttgatctcctgacctcgtgatccgtccgccttggcctcccaaagtgctgggattataggcaagagccaccgtgcccggcccaatgcccagctaattcttaaattttttgtagagatgagggtcttgccatattgcccaggctggtttcgaactcctgggctcaagtgatcctcctgccttggcctcccaaagcactgggattacaggcatgagccactatgcccagcagtaaattttaaaatacaaaatagtcttatatattctgtgggtacatatatatgcatacataaaagtggtaaactcagatggtggggagcagatctggattggggtggtgtatacatataagaggattttaactatctgtgttgttctgatttctaatggaaaatatgtgttatttctaaaaattttacttacacctaagaaaaatagaggaagttattatgccagatgttaatggctaattttgggtagtgggattatggtcagtcattctttcttgatccttcatgtcctctggaggaacacagtaggggtgtggctggcctgcagtgagtgaagggaaaatggtgagaaatggtgtttgagaagcagacgggccaagtctcctatgccctatttgaagtgtattcccttttccccatcccagacattttttgagctcctaaggtaggcctagatctgtgtgtggttgtgaggaatattaggctgtgtaacatccccagcctgccattgaggagctaactaggagttatgatgagacttaactagtaagttacccactttcatgataattacattaatccattcactaaggcagagcccttgtaacctaattacctcttaaaggtctcagttttacaaatttttttgtagaaacaaggtcttgctatgttgcctaggctggtctcaaactcctggcctcaagtgatccccctgccttggcctcccaaagtgttgggattataggcatgagccactgtgcccagcgtccacttcttaatagtgtcagaatggcaattatattttgacacaagttttggaggggacgttcaccctatagcaagagcctactggggaaggggctactctttcagctaagacgacccagtggggactcactgagggtgtggcagcatctgagctgagaccagaatgatgagtcagccatgtccacgagaaaacccaggggacaaatattccaggcagaaaaaaacagcccaggcagagacctcaagacagagccgagcttagcacatgccagggacaggtagaaagttccagagtagagaacaaaggggagaggtaggagatgaggctggagagaagccattgagggtgttcacaactcacagtgtcacttcttcagcaggtgggagtggtaggtgaacgtgctggtccatgaggcctggttcactggagaagaaaagctttagctaatagtctctggaaggttcactttgcttgttagtctcctgtagcacactgagctctaggctgagacagaggcaaaggtctcccctgactgctatgtgtatgtgctgagcagactctgcaggaccactggagcccagggaagcctgtattgcctgggaaggtcaatgaacaacacaggtcggggggatgtcagcgttgatatgtgtcagatctcctaatcctgcctgagtttcttcatctgtcaaatggaataacagttcttgggctggcaggatgcagtgagatgggcgtgtaaaatgtttatcccagtgcctgacacacagtaagcactcatcacgtcagccactgtggtacagggaacgggagagtgtacaagcaggactgtggggtgttgcccgctggcccatgggtgaaattgctgggtcccctgtatcactctggtcctctctccccagggtcactttcctccaaaggccattcagatcatgcagaagaagccttcctggagaacagaggatgagatccaggccgtctgtaacatcttgcaggttctggatagctatcggaactacgcagagcccctgcagctgctcctggccaaagtcatgcgctttgaacggtcagtgaggggcacagcccttggccaccaggctgaggctggactgagcaaaagagcctggctgagaaggtgtggcaggtcctgcccacccctctgcataatgtcagccatgaatgaagtcttctgtccattcacttcagctcccactgctatggtcgcagcaccctttatctcgctcacttattgagactcttaattaaagggccattaaatctggagaggatctagtagaaacctcagagaggatctggtccaattccctcatttttcagatgaggaaactgaggctctgtgggggaaaatggctcctcctaggtcacccagacaaaaagaaacagcgctgaagctcttttcagttacgcccatcagagcttgggatgaattctttctgaaacagcttggctttgcttgaattaccactgaggtcagtgatgctctgattgagagttgagaaagggtagtttcccaaaggagaatcagggtgtgattggtggaaaaatatgaccagatgcttgacagcaaaagcgacagatgtctgcttttggagattcgggttctagctctgacttgattgtggcttgccgtgactttcagcaagctgtgggttccttgggtccccctttccccttcccaaaaatgttggttgagcttgatggtctctgagggtctttctggctctagctctagtcatctttacttcagtgaacagtgcctgtgctccctcatcttcaaaatctcatttcctagctgaatattcctgctatctcccagctagtcattatcacctgggccatctcctctttctttattctttttattattattattttttgagatgggtctcgtcctgtcaaccaggctggagtgcagtggtgtgatcacagctcactgaagcctctacctcctaggttcatatgagccttccacctcggcctcctttgtagctgggacaaggggtaggcatcaccattcctggctaattttactttttattttttgtagagacatagtctcactatgttgctcagggtggtcttgaactcctgagctcaagtgattcttccacctcagcctcccaaaatgctgggattacagacgtgtaccaccgtgcctggcttgcctctttcctacattgataaagattccaggctgatactggtttgtagctcatgaagcccacagccacaatggaggctgggcagtactgactccagcctggtgtggtcctctgtctgtcctctgatcccttccctcaggagtttgccacagaatcacaaggccagtgagtactctctaagaggtcagaagaggagatgctgctgggggctgggtcagggaaggcttcctggaggaagtaggatctgagttcctgaaaggatctgaatagtggagaagacagggaaggccattgcaggcaggggagcaacatggacaaactgatggaacaaagtgggtatcatctgccctgagcagggtgttggttcccctgctgctggtcaagccagcgagtcaggaaggagcagaaggtggcagtgtggagggggaggaggaagaggaggaactgctgagggcagggccatgagctcagagctggggacaatggccctgctatcggggcacttccacaatggctgctcatcagtcctggcagagactaaagggcagacttttttttacccattgtctcctgggtaaaatccaaacttagctgagctttggaggccctttatggtgggaccagtcgaatttctctcccaccactcccctgacttgccttctcccattttcctttcccgtgaagtgcacattacctatgaagtacacgttatcccttgaatgtgccgtgctttgggccacctctgcacctttggtcatggtggtccctgtgcctgggaccctcttccatctctttgtccacctggatgactcacttcaagcaccatgctagagccttgtctgaccttcctaagcttggataaaggccccttctctgtgctcctcaagtagcctgcactgacatctcttaaagcatttttaaaccttatttacatcctgtatgtgaccataattttgaaaacaaagtctgtgttgttcattgtgcccaatttttttttttttgagacagagtcacccaggccagagtgcagtggtatgatcatggctcaccatagccctaaactcccaggctcaggtgatcttcccacctcagccttacaggcagctgggactacaggtgtgcacccccacatttggctaatctttgcattttttgtagagatgaggtttcaccttgttgcccacccaggagttcaagaccagcctgggcaacataacaagactccgactctccaaataatagaacaattagctggatgtggcaacttcaggtctcagctcaaatatcccttccttattgatagtaatagtaagaatagctaacatgggactgggcacagtggcttactcctgtaatcccagcactttgcaaggccaaggtgggaggatccttgagcccaggagttcaagaccagcctaggcaacatagtgagaccctgtccctatctcaaactcctaggctcaaatgatcctcccaccttggcctcccaaagtgctgggattaacaggcgtgtgccaccacacctggcctcacggtacctaacagacaccactgatatttatttaacttattgaatgaatgaaggaaaagaataaatatcgaaagaattgagatttggacttgcatacgaaatacagaaacttccctctgagtttaagaactccttgttcgctctgggcctgggcacctctaccccaagggtgcccagttgggtagtgggctgctggtaattatgataagaccattatctgtgtctcattctaggcatactcatctgcattttacagacaagagaaaccaaggatcagagaggggatatccattgctcagtgtcacacagctaagagcagaaccaggatttggatcctgggctaacgctaaagccagtcctcctaatcatttagtgactctactaacccattcattgctttcagcatgtgttcactcatttattccactatgttcaatgaacattcactgtgcccaagcacacgcagcagtgacccagactggcaaagactctgctctcaggaagcttcagttcaaccgaggcaggcaacgggataggtgttagtgaaaggctccagcttgactggcagggctgggctgtcctgagggcccttctggtccaagtctgtgctcttatatcccaaagcaaagagcacaaccagtccagagctcctctcagcttggacctgcccccatgtcactacccaatcaactagcagtggtcttttcccaggtttggtcgcaggcgtgtgatcatcaagaaggggcagaagggcaacagcttttatttcatctacctgggcacagttgcaataaccaaggacgaggatggcagcagtgccttcctagatccccacccgaaattgctgcacaagggtagctgttttggggtaagcccaggggaaggacccagtttcctggggtggagtgggtggaggtgacaggacttctgctagaacctctcagccaggcccagtcctgcctagtactctgtacaagtcagtgtcccgtgtgggccccttacctgtcaaatgctaattgagttggactaagatcagcctcttcatctgtgatgtttaagaagtatgttcctgatacagccctttagagatgaagtgactccatagtgaggcctctccagcttcctcccctctggcctgttcaggtctgttgcctctttttccataagcagcagattaagaagaaggggagtgggccccagtgggagaatgtgcaggagaatagaggaggctagggaacacacagtctggtgaggagagaattcagggggaagatggaggcacggaagatgtgtgtaaggctgaggacaggaagtggaggtggcctcacacttgcccttgccctgtccacccaacaggaaatggacgttctgcatgcttcagtgaggaggtccaccatcgtctgtatggaagaaacggagttcctggttgttgaccgggaggacttctttgctaataagctggaccaggaagttcagaaggatgctcagtatcggtttgaattttttaggtaactctgccttcattcaacatttttttccccttgtgtgtttattagctgcctgactttgtctgtcctaggcctggtgggaaacatactggttgctgttctctctgtctgggatgctctgaagtcccacctcgtacccaccttctctctctgcagactcctactatcccttcgggtctcagctcaaatatcccttctttattgaaagtaatagtaagaatagctaacacgggactgggcacagtggctcactcctgtaatcccagcactttaggaggccaaggtgggaggatccctgaacccaggagttcaagaccagcctggacaacatagtgaaatcctgtccctacaaaataaaaaattaaaaaaaattagctgggtgtggtggcacatacctatagtttcagctacttgggaggctgaggtgggaggatcacttgggcccaggagttcgaggctgtggtgagttgtgatcgcatcactgcactccagcctgggcaacagagtgtggtcctagtagctaggactgtaggtgtgctgccacatccagctaattgttctattatttgtagagatggaatcttgttatgttgcccaggctggtcttgaactcctggtctcaagtgatcctgccactttggcctcctaaagtgctgggattacagacatgagcccccatgctcagcccaaactataaaactataattccttttttttttttttttgagagagggtcttgctctgttgcccaggctggagtgcagtggcatgatctcatctcactgcaacctccgcctcctgggttcaagcaattctcctgcctcagcctcccacatagctggaattacagtcatacaccatcactcccagctaacttttttgtatttttagtagagatggggtttcactatgttggccagggtggtgttgaactcctggcctcaagtgatctgactaccttggcctcccaaagtgctgggattacaggcgtaagccactgcgcctggcccaaactataattcttgattgcatggtaatttctttacagtttatataccccctcagacagtaagcagtatggtgacagagaccagatagatctgtctttgtcactactataatccttatgttgtcacactgccagacacatgcaggtgctcaacaaataaatattgagtaaggtgaataacaggatataaataattacaatcacatgtgagtcagaaagtaagcaccgtaactgggtatcatatttaaaagcagaactcatacatagcaaaagatttttggtttttgaatacttatgtgcatgaaaggccacgtaaggatatgcaagtgaaatctcatttaattgctcttcagttatttgcctttatgtaaaaggaataaaaatccaatgaagtatctgcactggccctgaaaatttgggctgtagggctgcacagctacagagaagtgtgatggccgaggggtctggttcctgtggctggggctgagagaggtagcttcatcccctggaaaagtggggatttagtcctaaagggaggagctgttttttttttccatactgtggaaaaataggtctggctccaatctcagctcttaggttaccagcgatgtgaccctagataggtcacgccatttctctgtgttttagcctcctgctctgtaaaatggggataaggatacccttctcccaaggtcatggtgaggatggaatggaatgatcatgggaagtgtatggcccagtgcttggtgcgtggtaggtacttcttctatggtggccctacttttcttctggtgtcttcagaccttcgtccctgacatggcactgagcgtgttcacctctggtgccctgaccttaactcagtgcgcgcattgaggcctgagtcaccttgagttaacctgattcaatgaactcagtccacctgagtcagttaagttctgagcccttaacctgttggaggtgagaaaatctgagatgattgttggcagcacttggagcagcatatgaaggcaggcaagcctgtgaacgtggtgttcaaggtcaggggaaggggcagtcacagtggggtgggttcacccacagggagcaacaggcagaaagagtggagtccagacatgtcccactctccagacccagagctgaggatttgaagccaacaggccagggggacacaagggttggatgagctgcccaaagcaaaggtagggccagaaccgctaagttgggggacagagcagctgtgagctggagtggggactagcttcatgagccacggtggggagggatggcagggctggaggaggagaagattcttggaaggaggagcagaggtgagaaaagcacagaggctggatcacccaggggcatctgagcagcagtaaagaggggagcttggctggaggggagggccttgggaaaaggaggagggagccaaggtgatagcaggtaggagaatggctacaggcaaggccaggtaattgggcaggtagcagcgaaatcttccacccaggcatcctccacaggagaagagtatgtgccctctgcagattgctaaggtctgggcaccttgtgtgatggagttgatgaattctaacaggctcttcccacaggaagatggagctgtttgcatcatggtctgatgagaagctctggcagctggtagccatggcgaagatagagaggttctcgtatgggcagctgatctcaaaagattttggagagtcacccttcatcatgtttatcagcaaggtgaaaagtctgggggttgggatgagggtgaacctctgaggagcatgcctaagatcatgtcctgtgacctgatggtcagagtttgagcccttttctgcaacctgtgcaattcacttccttctcagagtttccatgtcccagctgtaagaggcctgcctctcacagagcatggctagagacattagatatatggctattgtgttagaaagaggaccaagggattctcccgccttgagctcctaagcatgcttatttacatatagatgcatatttaaattatgcatttggctgttgaatcttagtgatgccagatcacttttaaatttatttatttatttatttatttattttgagacaagagtctcgctgttgtcagcccaggctggagtgcaatggcacaatcttggctcactgcaacctctgcctcctgggtttcagcaattcttctgcctcaccctcctgagtagctgagattacaggtgcctgccaccatgcccggctaatttttgtacttttagtagagacggggtttcaccatgttggacaggctggtgtcgatctcctgacctcaggtgatctgcctgcctcggcctcccaaagtgctgggattacaggcatgagccaccaggcccagcctatttatttttgagacagagtcttgctcactctgtgccccaaactggagtgcagtgacgagatcttggctcactgcaacctctgcctcctgggttcaagtgattctcctgcctcagcctccagagtagctaggactataggtatgtgccaccatgcctggctaatttttttttgtatttttagtagagatggggtttcgtcatactggccaggctggtttcaaactcatggcctcaagtgatctgcctgcctcagcctcccaaagtgctgggattacagatgttagccaccacacccaaccttaaattatctttaaattgtaaaagtgatatgaccacattaggaaactttctggaaaaagggaagaaatcatccataaacccatcatctcagagtagagtttcaaaatggaatttcttggtatcatgattttgttttgtaaggcagactttattcaaaggggccatagccataggtatagggaccactgcaatggagtcttgcagccagagacagagattggactcaactctcagtatcgtaatttttatggctcctgcaacaaattgcattccaaaaggagagccccaccttatctagtgtccaggatgtacatttttgttggtgccatcacagctctgccagccttgcatgtcattttttcaaaagttttctagtttaataggtcgcaattgctgccatactgaggatttgatattttttctgattactagtgagatttatcatgtttgtttatgacctacattttatcttttgcaaattgcttcacgtcctttgccaccttctctgttggttgataatgaaaagaaaatctcccatttctcaagtgcttactgtatgccaggttctatgtttcacatgcttcatctcattttagtctctatagcccggaggaggttagtattgtcattattcccattttacagaggaggaaactgaggcacagtaaggtgaagtggttatccaaggtcacacagctgatgaagtgcagaggcagggttcaacccaagtctctctgactgcaaagatattttcaagaacttggatttaggatttgggctgacctttctgtctggttcttacagattaagccaccacaggcatttgttgagtttttgccaaggtcatgacacattggtccaggctctggagggatacaaagatgaaaaagactggttttctctctttatagatctcctccaccagattccacacatagacaaagaaaagtgtcaatgccaagtaccaagtgattggtgcaaactctgcaagttacaagatttcaggagagggaactctctaaaggctggaggctttaagaagggcttcctggaggaggtgaggtgggagatgagccctgacatattgaaccattaggcaaaaggaggaagcaagattggttgtgtgctggcactggcttgtacctgcctatgagagctgattgttaaattttcaggaattttggtaaacatagtaattattacaaattagatgctataaacctacaattaaataagttatatggaaaattaggagctgggcatggtggctgatgcccatagtcttaacgactcaggagactcatgcaggaagatcatttgagcccaggagtttgaaagcagcctgggcaacatagcaagaccctatctctaagaaagaaagacagatgagagagggagagagagagagagagagagagaagaggggaggggaggggagggggaagaaaggaaggaaagaagaaaggaaggaaggagcaagcaagagagagaaggaaagaaagaaaacaagggtaatacatactgaaaactcatcatttcctactgatgttactgcatttttactagtttttctcttcaggttacgtctattgtgtctctatggtagaaatactatgcaattgtgagcatctcttccccactccacattcagtgacctcatgttggtagcttacaattagccatggttggataatttatacaatggaatcagcaaacaccctaagtcaggtcttggtttagggctttgctgattgtcttaggaaagtgataaaagaaaatgcttataatgcagattaaatttaaaagtggcttgggtctatagctgctacactgcaaagagaatgaaatcgtctaacaatatttaaaagctattattgctccgggcgccgtggctcacacctgtaatcctagcactttggaaggctgagatggatggatcacttgaggtcaggagttcgagactagcctggccaacatggtgaaacctcatgtctactaaaaatataaaaattagctggacatggtggcgcatgcctaatcccagctacttggaggctgaggcaggagaattgcttgaacctaggaggtggaggttgcagtgagccaatatctcaccactgcactccagcctgggcaacagaatgagactccatctcaaaaaaataaaataaataaaaacaaataaaagctattatctggctgggtacagtggctcacgcctgtaatctcaacactttgggaggccgaggcgggtggatcacttgaggccaggggtttgagaccagcctggccaacatggtaaaaccccatctctactaaaaatacaaaaactagccaggcgtggtggtgtgcacctatagtcccagctactcaggaggctgaggcaggagaatcacttaaacctgggaggtgaaggttgcagtgagctgagatcatgccactgctctccagcctgggtgacagagtctcaaaaaaaattaatttaaaaaaaaagctattatctcattcatcatagaagttataccattgaacaaatgaagttctgatgtacatagtgctaaagctaaaaaacatttcagtttaatataatttatgtgagggtgagaaatagaacagtatatcacaagtcagatttaataacattgaatttattgggaagagaatggattgggatgcaacttcatttgtccaatcatgtttgagttgcaactataaactggccatggatacaagattcagccaaaacccacaaaagaattctgtgagagctgattggctgtatggaatttcctgtatggtatattttattatttataaattgtgtgtaacacattctgtataacaggtttatatgcaggcatatgttttttaggagagctggttgttaaacttaccagcaccaccaggggcgtggtgtgtgtgttgttattctcggctcagtcccagagaacagaatcaagtctagttaatataagtagcaaaagatttattgccagatatcaattggcagttccttctcctccttgatatttgcttcctctgtgctaaaattttgaggtgatcacctctgccatatctctccaaatttaactctaagctctttgatactatatagccagaaaagatggggggatgtgtggtgagggatagaaatcctttacaatattttctttaatcagcataatgattacattctgactggcagaaagcggggggtggttcttcatctgttttgcctccattgcttcacctgtgaaatggtaccaatcaccccataaagtctggtaaggatgagaatcagtttagtacatgcttactcagtgagcattcctcccgcaatccagtgcttctcaaagtgcggtggctggaccagcagcaccagcagcacttgggaactcatttcttcttcttttattttttttttttgagatggagtttcattcctgtcgcccaggctggagtgcaatggcacgatcttggctcactgcaacctccacctcctgggttcaagtgattctcctgcctcagcctcctgagtagctgggattacaggtgcccgccaccaggcctggctaatttttgtatttttagtagagatgggatttcaccatgttggccaggctggtctcaaactcctgacctcaggtgttccaccctcctcggcctcccaaagtgctgggattacaggcatgaaccaccgcgcctggcggggaactcatttcaaaatgcaaattctcaggcccacccaagagctactcaatccaaaactctaggaggaagggctcagtgatctgtgttttaacaaggcttccaggcgattccaatgcacactgatgtaggagaacccctgacctaagggaggaattttcaaattttggtaagcatccagacatgtagggtgcttcctgagggaggaattctcaaactttggtaagcatacaaacacatagggtgctttttaaaaaggcagatttgctgtctcaccccagagattgattcattaactctggaatctgcatttgagcaagtgctgtaggggattctaatgcaggggtgctgagccttcattctgagaaaaataatgcggaagtcactaaaggacagcaaggtagggagctcttggccagaagatgaatctggtttgttccttacagtgttttattaaaatctgatttaatcatcaatgtgaagattttatataaaaattctgatttctggcttttgagaattcagaggatcaggcaacaacaagccatattttggtacagcaccccctcccccaccccccgaccctggttggaaatgaaaagcaccagccccctctaaaggactgctcttttctctctttttttttcctgcctggccagcgttttttgagtgttcatctctgggagggagatcaagctgtcccgactcctgtagtttactcatattaccactagagggcaaaatcagctgcgggtggctggacacccctgggacctcagaaagctagagaagatttcctgatggcatcgaaaacttaatgcacactttcaactcatttctaacagtttatcactgggggacacatagtggaactgttctctccatagatgcaattaaagacctactaaatacttgaggaaaccgggctcatgttgtttctctggcacctgcagttcccctatagctcaaaaaaaagaaaaaaaaaagtatgcagtaaagatttcaaatctaaactttacagcttcataaatttttatatatgtatacacctgagtgatcattacccaaatcaagataaaaaacatttccactactccagaaggctctcctgtgctccttcctagacaaaatccccccacaaagcttaatactcttaagacttatgtcaccacaggttacttttgcatgtttttgaacttcatataaatggaatcatacagtgtgtattccttgtttctgacttcttttgctcaactgaatatttgttatttttaattttataaattatggtgtgcatagaataatatgtgaccattaaacatgatactatagaaccatattgtttggcatgaaaagaggtatttgatatattattgagtttcttaaaaagttacaagagtctgttttatgtaaatgaattcgttgatgaaaaattgtagatatacatcttatatgttcatagagaaaagtttgaaataatattcactaatatgttactactagttatttctgagtgtcaggattaatgtagtttttatctctatgtttttatgtctggtttgaatatttttaaactttcaattttggaataattttaaatttataaaaaaattataagaacagtacaaagaactcctgtagctggaactacaggcatgcaccaccatgcccagctaattcagctaatctttttttttttttttttttttttggagacagaatttcactcttcttgcccaggctggagtgcaatggcatgatcttggctcatggcaacctccgcctcctgggttcaagtgattcgattctcctgcctcagcctcctgagtagctgggattacaggcatgcgccaccatgcccggctaattttgtttttttttgtttgtttgttttgttttgtttgagccagagttttgctcttgttgcccaggctgcagtgcaatgatgcgatcttggctcactgcaacctctgcctcctgggttcaagcgattctcctgcctcagcctcccgaatagctgggattacaggcatgtgccaccacacccggctaattttgtatttttagtagggacggggtttatccatattggtcaggctggtctcgaactcccgacctcaggtgatctgcctgcctcagcctcccaaagtgctaggattacaggcgtgagccacaaggccggcttaatttttgtatttttagtagagacaaaataattttgtgttgccatgttggccaggctggtcttgaactcctgggctcaagtgatcttcccacatcagcctcccaaagtgctgggattacagtccgtgagccaccgtgcctggcttatatttagttcttatgcttcttcagttacttgaacttcgtatggtgagtaaataacattttcatttaaaaaaaaaaaaagaaaaaaaaaaagcaccaggctgggcgtggtggctcacacctgtaatcccagcactttgggaggtcgaggcaggcagattgcttgaggtcaggagttcgagaccagcctggccaacatggtgaaaccccgtctctactaaaaatacaaaaattagccgggcatggtggcacatgtctataatcccagctactcaggaggctgaggcaggagaatcgcttgaactcaggaggcagaggttgcagtgagccgagattgccccattgctctccagcgtgggtgacaaagtgagactccatctcaaaaaaaagaaaaaagaacctgaaaccacttgcattaagcaaataaaacaaaatgggataagatgcaattaagagagattttcttcaaagcctggcctacctggagccttaggggttaacccttttcctatgtcccttgctgtgttcagggcagctgtgaagtcctgcggctgttggaccttggggcctccccttcctaccgtagatggatctggcagcacctggagctgatagatggcagacctctgaagacccacctgagtggtaagctgccttggcctgtctgacagcagggggcgcctgggcctgtcctgtttccagttcccagcacatagagccttagaaatctagtcagccagcctgacagcgtatatcatctgcacccttctaccagcggtggaaacccagtctgcaaggccctgccctcctttccagccttttttttttattgagccttttcccttttgctgtttaggttctcccacgtgaccatcaactccttgcctcacatatcccccaccctttttttcacccagctctcttctgctttttaaaatttatttatttatttgttcattctgtctctggatttgcctgtgatggacttttcatataaatagcatcatacattatttggctttttgcatctgacttccttcactgagcaccatgttttcaaggtctatttatgttgtagcagatatcatttcttcattctgttttatggctgaataatattctaatgtatgcatataccacattttttttgtccacttatcagttggtgaacatttggattgttttcactttttggctgttttgaataatgttgctatgaacatttgtatgcaagtttttgtgtgaacatatttttcagttctcttgggtattacctatatgcctaggagtggaatttctgggtcatatggtatcttagtcagttttctatttctataactgaatatctgagactgggtaacttataaagaaaagaaatttatttcttatagttctggaggctagggaatctgaggtcgaggggctgcatctggtgaaggacttcttgctggtggggactcttcagagtcccggggcagcaaagggcatcacatggagagggagcacttctgtctttgagatcttagactacacattcttccttgaagaagtcttcctggtttctcatgctggaccagatcttccatcctctgctatatgccattctagtacccttcaagtaccattcaagtactcttctgtgttatataaccccactgaaatcatacaactgagtctgaaatgcttattaaacatctgtttcccttgctagaatataagctctatgaaggctttgcattcccagggcttcgtattatgcctggcatctagcaggtgctcagaagtgaattacagagttaatggataaacatattttggctgctgtgtgtggtttggacacatcctaggctgtgaatgtatgcgcactctccacagccttatcccaactcagtaacaagtatgaataacagtgatcatttattgaattctaattgtatgtttattatattgggcttgactgtttatacatattgcataattctcataatagctctctttttgttttttttttttttttggagacagagtctcactctgttgcccaggctggagtgcagtggtgcagtctcagctcactgcaacctctgcctcccaggttcaggcaattctcctgcctcagcatcccgagcagctgggattacgggcacatgccaccatgcccggccaatttttgtttttttagtacagatgggatttcactgtgttggccaggctggtctcgaactcctgaccttaagtgatccgactgcctcggcctcccagagtgttgggattacaggcatgagccaccgcacctggcctaataactctttaagaaggtacgattgtaccatctgacacatgaggaaactggctcatagggcaaataagtagcaatgtaggactgtagagttgggattctaacccaggcacaactggttccaaagcccagactttcttctcttcataaatatctccagccttcttcattctccatttcctgttgttggacatagacgttgtcaagtagcagcctctagaactggccagggtgataaccaggcttgctgattctagggtagtattgtttccattcacagctctgtaatggcatttttatttatttttttccccttccatcctctgcagatctttttgtgtcacccacttgggtcaaggaccccagccctcaacagatatttgcagtggctcagatgtcttatctcttacctcctgctcagtactggcatgcttccccccacttcccttgagattgtaatctgtgtatcctggggcctcctccccaaggattgccttatagatatagcagtcctcctgagattagaactgaggccaacacagggtggcgaggagaagggcggaaaaaggagaggttggagctgaacagagctgggtttgagtcccatttattagctgggtagctttggtgagtactcaaagtctctgggcctggtttcttcatatctaccttgggtagtgtcatggttagcagcataggcttggagtccactgcttctgtttgaatacagggtccttctcttattagtgatgtgatactgggcaagtgggccctatgtctaagtgcaccagtgccctcagagtctgtaaaatgtaaataatggtccgtacctcgtaggattgtaatgacattaagcaaattaatatataaaaactcttagaacactacctggctgcataggcagatggcagatgtttgttatcattaccacaacaggctgctaggaaggcagagtgagatgatgtatgcatgaggccttataagtactcagtaaatgtttcttctcatgtcaattcttgtttgtcacttttccactgtcaatccaccagagaaaaagttgcatcccacaaattttgatatgttgtattttcaatgttattcagttcaaaatacctttaaatttctcttttgatttcttctttgacccatggaatatttagaagagtgtttagtttccaagcatttgggggattatccacctatctttctgttactgatttcttttttctttttctttttttttttttttttttgagagggagtctcgctctgtcacccaggctggagtgcagtggtacaatctcagctcacttcatcctccaccccccaggttcgagcaattctcctgcctcagcctcccgagtagctgggattacaggcatgcaccaccaaacccagctaatttttgtattttagtagagatggggtttcagcatgttggccaggctgggcttgaactcctgacctctggtgatctgcctgcctcggcctcccaaagtgctgggattataggcgtgagccaccacgcctggcctctgttattgaattctaagataacatactttatatgatttgaatcctctgaaatgtattaaaacttgttttatggtccagaatatagtctgtcttggtaaatgtttcatttgcatttgaaaaaaacttgctgttttggggtgcagtgttctatgaatgttaagtaggtgaagttggttgatagtattggtcaagtcatctgtacccttataactttctgtctacttgctctatcaattgttaatagaggctggcgtggtggttcacgcgtgtaatcccagcactttgggaggccaaggcgggcagatcacctgaggtcaggagttcgagaccagcctggccaacatatagtgaaaccctgtctctaccaaaataatacaaaaattagctgggcatggtggcgcatgcctgtagtcccagctacttgggaagctgaggcaggagaattgcttgaacccgggaggcagaggttgcagtaagccaagatcacgccactgcactccagtccgagcgacagagcaagactgtgtctctcaaaaaaaaaaaaaaaaaaaaaaaaaattcttaatagagttgttaaaatctccagccataattatagatatatttttctccttgtatttctgtctgttttgcctcatatattttgaagctcttttattatatgcatagatgtttgggattgaactcttaattattatgaaatgaacttatttgtccctggtaatattctttgctctaaaacctactttttctgatgtaaattcagccacttcttttgatttagtgtagcttcctcttgattagtattagtttggtatatctttttccatccttttgtgtttaacctatttgtgtctttatatgtaaaagtgaatttcttaaaggcagcatataattggatcttgctgaaagacccaatttttattgagatgcctaatcattgacatttaatgttaatattgattatggttggatttgactctaccatcttgctatttttctttctatttgtcacatctattccctttttcttctgtttttccctgccttttggattatgtattttgtataattcaatcttattttctttgttggcttattagctgtttgtggtattattttcacagttgctttatgatcattgtatatacttttaacttatcacagtctacctttaagtgatattataccacttcatgtatagaatcagaatcttacaatgatatatttccattttctcctcctagatattatgctattgtgatatattatactttaatgtatattaaaaaccttaccatacatggttattacttttgctttaaacaagtatcttctttttttttttttttgagacggagttttgctcctgttgcccaggctggagtgcaatggcacgatctcggctcactgcaacctccacctcctgggttcaagtgattcttctgcctcagcctccctagtagctgggattataggtgcctgccaccatgcccagctaattttgtgtatttttagtagagacagggtttcactatgttggccaggctggtcttgaactcctgacctcaggaaatccacctgcctcagcctcccaaagtgctgggattacaggcatcagccaccatacccagcttaaacaagtatcttttttgtatatttaaaaaataataagaaaagactcttatgttaacctacatagttactatttctgatgttctttgttcctttgtatagatccagatttctacctaataaccacttccttctgcctgaagtacttcctttaacatttcttgtatttcagctctgttagtgatgaattatttcagcttttctatgtctgaaaactattttatcttcatttttgaaagaaatttttgctggatataaaattctaagttgacaggttttttctttcactactttaaagatgttgcattaaagtcttttttgacttgcattgttttcagcaaatccgttcatatttttatttattgttttcaacaagaagtccgttaacattttatttatttatttatttatatttttgagacagagtctcactctgttacgcaggctggagtgcaatagtgtaatctcggctcactgcaacctctacctccctggttcaagcgattaccctgcctcagcctcctgaatagccgggactacaggcatatgctaccatacttggctaatttttgtatttgttgttgttgttgttggtttctgagatggagtcttgctcttgtcacccaggctggagtgcaatggcacaacctcggctagctgcaacttccgcctcccagtttcaagtattcttgtgcctcagcctcacgagtagctgggattataggcgtccaccaccacgcctggctaatttttttttttttcatttgtgtatgaaattttttttttttttttttttgatcattcttgggtgtttctcgcagagggggatttggcagggtcataggacaatagtggagggaaggtcagcagataagtgaacaaaggtctctggttttcctaggcagaggaccctgcggccttccgcagtgtttgtgtccctgggtatttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggataagaatttttcttagtacagaacaaaatgaaaagactcccatgtctacctctttctacacagacacggcaaccatccgatttctcaatgttttccccacctttcccccctttctattccacaaaaccgccattgtcatcatggcccgttctcaatgagctgttgggtacacctcccagacggggtggtggccgggcagaggggctcctcacttcccagtaggggcggccgggcagaggcgcccctcacctcctgggcggggcggctggcagggtggggggctgacccccccacctccctcccggacagggcggctggccgggcagaggggctcctcacttcccagtaggggcggccgggcagaggcgcccctcacctcccagacggggcggctggccgggcggggggctgacccccccacctccctcccggacggggcggccggctgggcggagacgctcctcacttcccagacggggtggctgccgggcggaggggctcctcacttctcagacggggcggctgccaggcggaggggctcctcacttctcagatggggcggttgccaggcggagggtctcctcacttctcagacggggcggccgggcagagacgctcctcacctcccagacggggtcgcggccgggtagaggcgctcctcacatcccagacggggtggcggggcagaggcgctccccacatctcagacgatgggcggccgggcagagacgctcctcacttcgtagatgggatggcggccgggaagaggcgctcctcacttcctagatgggatggcggccgggcagagacgctcctcacttcccagactgggcagccaggcagaggggctcctcacgtcccagacgatgggcggccaggcagagacgctcctcacttcccagacggggtggcggccgggcagaggctgcactctcggcactttgggaggccaaggcaggcggctgggtggtggaggttgtagtgagctgagatcacgccactgcactccagcctgggcaccattgagcactgagtgagccggactccgtctgcaatcccggcacctcgggaggccaaggctggcggatcactcgcggttaggagctggagaccagcccggccaacacagcgaaaccccgtctccaccaaaaaaatacgaaaaccagtcaggcgtggcggtgcgcgcctgcaatcgcaggcacttggcaggctgaggcaggagaatcaggcagggaggttgcagtgagccgagatggcagcagtacagtccagcttcggctgggcagcagagggaaaccgtggaaagagggagagggagagggagaccgtggggagagggagacggagaaggagagggagagggagagcctaatttttgtatttttagtagagatggggtttcgccatgttggccaggctggtctcaaacacctgacctcaagtgatccacctgccttggcttcccaaagtgctgggattacaggcataagccactgcacctggccaacatttttatttttgtataaactctttatataaccttgtatattttctgtacacagtgtacctttttgctttggctgattttgaatttttttatcaatagttttaagcaatttgattatgttgtgccttggtataatttttgtcatgtttctgtgcttgaggttcatttagtttctgggattcctgggtttgtatttttaaaatctgatttggaatattttgaccatgattttttcaaaaaaattatttgtctctccctctcctccactttgagaactccaattacatgtatattggattgcttacaatccaatatattattggattgcaacatgtatattggattgctgtgtttcacagctcactgatgttctgttcattttttttattcttttttttttcctctgtgacattttggatagtttctattgctatgtcttcaagttttctaatcctccttctgcattgtctaatctgctgttaatcccacctagtgtacttttcattttagacattttagtttttatatctcaaagtttgatttgggtctttttataatttccacaactctacttaatatacacaatattttttccttggaatataattataatagctcttccaatgcccttatgtactaattccatcatatgtgtcatttctgagtcagtttcaatccattgtttccttttcatatagtttatattttcctacttctttgtatccttcatgattttttaataggatgctagaaaatgtgaattttgagtactgcatattttttattcctgtaaatatttctgaacgttaagatgtagttacttggaagtattttgatcttttcaaggcttgcttttaaatttgttatgtggggtcagaacagtgtttaatctagagctagtttcccattcgtgaagtaaaaccattttgtgtatttcagaatgccccatgacttgagaggttttctattctagttattgggaaaaggactatttctggtcctgtttgagctctgatgatttatccctctaatcatttggggtgattctttccccagccttgggtagtatactatgtaacaaattgccccaaaacttagcaacttaaaataacagacatttacttctcccaatttctgtgagtcagaaatttgggcacagcttagtttggtgcttctgactcaagacctcttatgaaccagctacttgggaggctgaggcaggaggatcatttgagtccaggaattcaagaccagcttggaaaacatagctggactccatctgaaaaaaaaaaaaaaatctcttgaggttgccattgtcagccagggttgtggtctcatctgaaggctcatctgggagggacctgcttccaggctaactcacgtggctattggccaagtgtctggcctcatgggtgtctctacagggcagtttcatgacatgtttccccaagaatgagagagagcaacagagaacatgcccaagatggaagccacagtttttttataacctaatgtcagaaataaaatctcatcacttctgctgtatcctgttagacgtgagcccaacccacacttaatgggagggtattacacaagtgtgtgactagtaggaggtggggttcactggtggccatctcagaggctgcctaccactggtagtttcccaatacacatgtgctgattaatactcagctgagcttcaggggaaactctctgcagatctttggagttctgtctctatgcagctctcttctctctggttccctgctctgtggactctagctgccttgccctcccctgactatgtcttctgtctcatcaattcaaggagattgctgggctccatctgagttccccctccctgcaccatggcccagaaaatctttaggcagcatgctggggcagtagtagggctcacctcatttgttttctgtcttgcatcatggatgattgtcctttattgcctgatattcaatgtctttttttttttttgagacagggtctcactctgtcacctaggctggagtgcagtgacctgttcatagctaattgcagcctggacctcctgggctcaagcagtcctctcgcctctcctgagtagctgggactataggcatgagccaccacacccacctaattttttatctttttgtagagatagagtctcactatgttgctcaggctggtcttgaactcctggcctcaagggatcttcccacctcagcctcccaaagtgctgagattacaggcatgagccaccgcatctatccttcaatgtctttaaaacaattttttccataaatgttgtccaatattttcaagtagaagagaaaatttagtccctgttattccatcttggctggaagcaaaagcagaagtctagatctatgtttttaatagttgagttttattctattatatgcatatatcataattaatttaattaccttttacagatattttgaattctttttcaaatgtttaccctactgtggcagatttcctggtgtgtttgtctttgcatctgtgtgcaaggaaacgtattagacaaattctgagaattactggatcaaatagttcagcggtccccaaactttttggcaccagaggctggtttcgtggaagacaattttttcacagatgggggcaggtggtaacgcttttggaatgaaactgttccacctctgatcatcaggcattagatggagcacacaacctagatgcctctcatgcacagttctcaatagggtttgtgctcctatgagactctaatgccgccactgatctgacaggaggtggagctcaggtgataatgctcatgcacctgccactcatctcctgctgtacagcctcattcctaacaggccacggacctgtaccagtccatggccaggggattggggacccctgaaatagttaatccagtgcatactgactacatacatttaaaacattggtagatgttgttgaagtgcctttccgaaagatcaaactcagggctttttatatgtgttttgttaagccagacctactgcttgtggaacttggatttattcccattaacattaatttgaggggccgggcatggtggctcacacctgtaatcccagcactttgggaggccgaggtagacggatcacgaggtcaggagatcgagatcatcctggctaacacggtgaaacgctgtctctaataaaaatacagaaaaattagccgggcatggtggcgggcgcctgtagtcccagctacttgggaggctgaggcaggagaatggtgtgaacttgggaggtggagcttgcagtgagccgagatcaagccactacactccagcctaggtgacagagcaatactccatctcaaaaacaaaaaaacaaaaacaaaacaaaacaaacaaaagacattaatttgaagagttgattctcatactagagattttttttttctttttttttttgagatagagtcttgccctgtcacccaggctggagtgcagtggcacgatcttggctccctgcaacctctgcctcccaggttcaagcaattctcttgcctcagcctctggagtagctgggattacaggcatgcaccaccatgcccagctaattttttgtatctttagtagagatggggtttcaccatgttggccaggctggtctcgaactcctgacctcttgatctgcccgcctcggcctcccaaagtgctgggattataggcatgagccaccacacccggctggagatctcttttttaatcaatgttcttgacgtataatttttatataatagagtgcacatattttatgtgtatagttaaatgacaaattagaaaaaaaattctttttgagacaaggtttcactttgtcacccagtctggagtgcagtggcatgaacatggctcaatacaaccttgacctcccagactcaagtaatcctaccactttagcctcctgagtagctgggactacagtcacatgccaccacaccctgctaatttttgtatgttttgtagagacgggggtttgccatgttgcccagactggtctcgaactcctgagctcaagcgatcctcctgccttggccttccaaagcgtgggattacagtggcgtgagccactgcgcctggccatagttccatgacaaatttatacctctacaatcaagttatagaacatttccatcaccccacaaagttcccttgtgccgcctcccagtcaatctctacccctcacccttgccctaggcaaccactgatttgttttctatcattataggttagatttgtcttcctatggtttcatataaatgagatcatacaggccaggcatggtggctcatgcctgtaatcctagcactctgggaggccgaggcaggtggctcatgaggtcaggagattgagacaatcctgactaacatggtgaaaccctgtctctactaaaaatacagaaaattagctgggcgtggtggtgggcgcctgtagtcccagctactcaggaggctgagacaggagaatggcatgaacctgggaggtggagcttgcagtgagcagagatcgcaccactgcacttcagcctgggcgacagagtgagaatcctctcaaaaataaataaataaataaataaataaataagatcatacagtatggactcttgtttctggcttcttttacttagcatgctgagtagtttgctcctttttatttctgaattatatttccttcgagtttttttaaatttcattttaagagatgaggtctttctatgttgcccaggctgaagttgagctcctaggctcaagcaatcctcctacctcagcctcctgagtagctaggactcaggtgtgcaccactgcaactggctcttggtgatctttttaaataactctcatggagggcctattatatgtcggtgctgtgctaggcatatcacatactttatctgcaattcttttttttgaggcaaagtcttactgttgcccagactgcacacagtgttgtaaacacagctcactacagcctcaacttcctgggctcatgcaatccttccatctcagtgtccccagttgctagagctacaggtgtgcaccagcatgcctggctaattctttaatttattgtagagatgaggtcttgccatgttgcctaggctggtcttgaactcctgggctcaagtgatcctctactttgatctcccaaagtgctgggattacaaatgtgaactaccatgcacagcctgtaattcttacaatagttctatgagagggctctgatgcttatatgacttgtccaaagttccatgaccagtcatccatttatctcttattgctgactctgccccaatttgaaagcccagtttgaaggccgggataaatatggtctgttaatggaatgaatccaagagacctgagttcaaatccaagctttaacctttttctgggtgacttgagctctctgctgttcatcttatctcttaaagtgtgttaatcacccttctccagatgtaatagatgtaaaggctctagcgcagggcctgccacccagggacattacatggaggccacagtgttttatctttcttttttttttaaaaaatttccccatgtgctagaccatccaggcaggttcctgtgataagcttcaactactaccaccataaccatcatatatgcaaagatccataagtatcttttcctgtgctttctctaacagaatactctcctatggaaagatttaaggaattccagatcaaatcatatcctctgcaagactttagctccttgaaacttccacatctcaaaaaagcctgggggctacaggggacaagcttcagcaggaagatcagaacctcaggagacactctccccaagatgctgggcccgaagatccagtaagctcagccctgggcagatagacgggtccagattgtggttgcaaagggagataatacttatatggcagaatgtcagggatgcggataaggggcaaaggtggaggacacaggtcaatcccaaaggattgtgcatgaggcaacctagagatgtcctgggtctgagagccaggacctgcattctccacctgtaactcacaaggctacgtcaggcattcagccacttcttttctcagggcctcagtaacccatttaaggaagaaggggctggacatatcttctggctctgacattctgtcagtctgtgtgtttctgggcccttttgattctgagctgcttcagaaaattctgtccatctaaggaaggcagttacagcatagtagataagagcctgtgtttggaattaagcctggcttggccacttattttagctcttattttagaggtcaagggacttgacctctctaagctgtatttcttggtagataatagcatctaactcttggggttgttgcaagccagcaattaaatgagataatgataattatagttaacacttacagagtattttttgtagctgggcatagtggcacatacctgtaatcctagctactcaggaggctgacacaggagggtcgcttgagcctaggaagttgaggctgcatgcagtgagctgtgatcatgtcactgtaccccagcctgggcaacagagcaagatcttgtctctctctttttttttttttttgagatggagtcttgcactgttgcccaggctggagtgcagtggcgcgatctctgctcactgtaagctccgcctcccgggttcacgccattttcctgcctcagcctcccgagtagctgggactacaggcacctgccactgtgtctggctaatttttttgtatttttagtagagacgaggtttcaccgtattagccaggatggtctcggtctcctgacctcgtgatccgcccacctcggcctcccaaagtgctgggattacaggcatgagccaccacgcccaaccgaccctatctcttaaaaaaagaagaaaaagaaaaagaaaaaggaaacaggctgggcatggtggcttatgcctgtaatcccaacactttgggcggctgaagcgggcggattgcctgaggtcaggagttcgtgaccagcctggccaacatggtgaaaccccgtctctactaaaaatacaaaaattagctgggtgtggtggcggatgcctgtagttccagctacttgggaggctgaggcacaagaatcgcttgaacccaagaggcggaggttgcagtgagctgagatcacgccactgtacttcagcctgtgcaacagagcgagactgcatctcaaaaacaaaacaaaaccccttttctgtgcccagtactgaattatctaatttaatctctgtaacaactctacgagtactattataatcattcccatttttcaggtgagaaaaccaaggtacggggagagattgagttgtttgttccaggttgcgcaggtagaaagtggcagagccaggattcaaacctgagcagctcagtgttgttatcggtatgattgtcacgactggtatgaggcagatgcacattggggtgctgtgcttttgttttttctggagagactgaagagcagaagaggagactcagtggggaccagcctagaatcagctcattgctgggcccagagcagcacagccccctccccctgctacttttgaaattgaagtgtcataatgagactaacaatggcaccagtgtcacaatccctgcattcctacaagggccacttcacgtgagtcctttgcctgttaacatttccaagctcctggcctccataacgagcaccctgtgacttttgagacgttatggataatccttctgaagaatctaggttgcagtgagccaagattgtgccactgcactccagcctgggcgacaagagcaaaactctgtctcaaaaaaaaaaaaaaaaaagaaaagaaaagaaattccttcctcttggctgggcgcagtggcttacgcctataatcccagcactctgggaggccaaagcgggtggatcacttgaggccaggagtttgagaccagcctgggcaacattgtgaaaccctgtctctgctaaaaattagctgggcatggtggtgggtgcctgtagtccctgctacttgggaggctgaggcatgagtatcacttgaactccagaagtggaggttgcagtgagcagagatcccatcagtgcactcgagcctggcgacagagtgagactccgtctcaaagaaaaaaaagaaaaaaaaaaagaaagaaattccttcctcatgctgagcatgagagggccagcctggacttcccacccattaggcctggcttggctgcatgggatcatcagcccctgcctccaggagaacagccctcaggtgtttaaggggagggcctgtatcaccttcctctcccaagtctcctctttcgcaccctccaattcctgacaatgggagtcagggcttgattttgagttttctcgccttctgggaagttgtgaattccccagggaggggagccctccatgtgcagaagagtgagggctgattagccagggcctcaggagcagactgtgttacagatgagctctctaacaagctgtcacatttcagatccaggcctgctcagtcgatcaaatgtgccatgatcaatatcaagcctggtgagctccccaaggaggctgcagtgggggcctacgtgaaggtgcacactgtggagcagggagaaattttggtgagtgtgccaagagctctgttcaccatggagtacgtaacatgaatgggctggaatgttaagtaatgacagtaaaggtttaaaaacacttccctccatatttgatattaaggaattatgttgatttgtaaagatgtgataagaataggccgggcgcggtggctcacacctgtaatcccagcactatgagaggccgaggtgggcagatcacaaggtcaggagtttgagaccagcctgaccaacatggtgaaaccctgtctctactaaaaatacaaaaattagctgggcatggtggtgtacgcctgtaatcccagctgaatccaggaacaaggcaaagatgttccctcttaccactcctattcaacattgtattgaaagtcctagctagtccattcaagaaaaggaaataaaaggtatacagattgggaagtaagaaataaaactatctttgtttgcagataacattattgtctatgtagataattccaaacaatttttttaaaaagaaaaacctcctgaaactaatgagattatagcaaggtcacaggatacaaaattaatatagagagtccattgctttccttataccagcaatgaacaattgaaatttgacatttaaaaacacaataccagctgggcacagtagccccagcactttgggaggctgaagcgggcgaatcacttgaggtcaggagttcgagaccagtctggccaacatggtgaaattccatctctgctaaaaatacaaaaattagctggggccaggcatggtggctcacgcctgtaatcccagcactttgggagcctgaggcaggttggatcacttgaggtcaggagttcaagaccagactggccaacatggtgaaaccccatctctactaataatacaaaaattagccaggcatggtggcacacacctgtaatcccagctactcgggaggctgaggcaagagaatcacttgaacctgggaggcggaggttgcagtgagctgagatagtgacgttgcactaaagcctgggggacaagagtgaaactccgtctccaaaaaaaaaaaccaaaacccaaaccaaaaagccaggtatggtggcaggcacctgaaatcccagctatttgggaggctgaggcacaagaattgcttgaactcaggaggcagaggttgaagtgagccgagattgtgccactgcactcctcttgggtgacaagagcgaaactccatctcaaaaaaaaaaaaattaataacaaatacataaattacctaatatttttatagaatctaatttctaaaaaattcaatttctaggccaggcatcgtggctcacgcctgtaatcccaacactttgggaggccacctgaggttgggagttcgagaccagcctgaccaacatggagaaaccctgtctctactaaaaatgcaaaattagccaggcatggtggacacctgtaatcccagctactcgggaggctgtgtcaggagaattgcttgaacctaggaggcggaggttgcagtgagctgagatcgcgccattgcactccagcctgggcaacaagagtgaaaatccgtctcaaaaaaaaaaaaaaaaaagaattcaatttctaagaaatccattatgaaaaggctaaatattgcatgattccaattctatgacattctggaaaagaaaaacactatagagatagtaaaattatcagtggttgcaagaggtttggagttcaggagatgggatgaataggtgaagcacaggggacttttagggcagtaaaattattctctatggtactgtaatggtggatacaaaagcatttgtcaaaacctatttaattttacagcacaaagagtgaatcttaatgtatgcaatttgttaaaaaagaaaaaaaatcagccaggcatagtggctcacgcctgtaatcccagcactttgggagtacgaggcaggtggatcacgagatcaggagattgagaccatcctggctaacatgatgaaaccgcgtctctactaaaaatacaaaaaattagccaggtgtggtggtgggtgcctttagttccagctactcgggaggctgaggcagaagagttgcttgaacccgggagttggagcttgcagtgagcagagatcgcgccactgcactccagcctgggcaacagagcgagactccatctcaaaaaaagaaaaaagaaaaaaatcatctaggaggttagtggatctgaggaaggaatacaaactatgacaagataatctaaccattataaatgtatgaaacaatctctgtgaaggagttggggggaaaagatgctgacttaagtaactttggaaatgagtggaactggtaagactaaagcaaaaggaactgtgtctgagcactgtgccctagtgataaagctgtttgtcatgaaggtagggattaacaatacttctactactatacatgtacacagtgttaacactgaaataaatcagttcagtaaatggatggcagagggtgggagccaggtttttcacaatttaagcaggaatatatagaaagcagggggagcctagaatactccatgtagtaatggattagagttgaaaacatcagtagtcactgaaatttaactcaatatatacttacagataattatgtatagaaatatgtataggtaggccaggtgtggtggctcacgcctgtaatcccagcactttgggaggccgaggagggcggatcacgaggtcaggagatcgagaccatcctggctaacacagtgaaaccccgtctctactaaaagtacaaaaaaaattagccgggcgtggtggcaggcacctgtaatcccagctactcaggaggctgaggcaggagaatggcgggaacccgggaggcagagcttgcagtgagctgagattgtgccactgcactccagcctaggtgacagagcaagactccatctcaaaaaaaaaaaaaggaaatatgtataggtatgggtggaaacatacaactgttttgctctgtcagataatagggcctaaaagaaatgttacccttccagcaatgagcacacttaacacttggatcttggttggtttcttttctttctttctttcttttttttttttttgacagagtctttctctgtcacccaggctggagtgcagtggcgccatctcggctcactgtgacctctgcctcctgggttcaagtgattctcctgcctctgcctcctgagtagctggcattacaggcacacgccgccatgcctgactaactttttgtatttttagtagagacggggtttcaccatgttggccaggctggtctggaactcctgacctcatggtccacccacctcggcctaccaaagtgctgggattacaggcatgagccactggacctggcctcttttattttttttttaagagacagggtcttgctctgtcactcaggctggagtgcagtggcaagtgatcatgggtcactgcagccttgaactcctgggcccaaccaatcctctcacctcagtattctgaatagctgagactacaggtgtgtgctgccatgcccaactaattttttttatttttcgttagagacagggtctcactatgttgcccaggctggtctggaactcctggcctcaagcaatactcccaccttggcctcccaaagggctgggattacaggcgtgaaccatcgtgcctggcctccatactgtttttcatgatggctgtactaatttatattcccaccaatagtgtgtgagggttcccttttttgcaaatctttgccaacatttgtcatattttgtctttttgatagtaaccattttaacaggtatgactcaacatctcattggattttcaatttgtatttccatgatgatcaatgatgttgagcatttttttcatatacctgttggtcatttgtatgtcttcctttgagaaatgtctattcagagtttttgcccacttcttaaccaggctgtttgatttcttgagactgtgttgtttaagttcattatacattttagttattatccccttatcagatgtacggcttgcaaatattttctaccattctttaggttgtctttttactttgttggttgtttcctttgctatgcaggagctttttagtttgatgcaatctcatttgtctatttttgcttttgttgcctgtgtttttggggtcataccccaaaaaaaaccattgcccaggccaatgtcaagaaaccagatcatgatttctaatacagtttcccaataaaaggaacaagggctctttggaagaatggttgaatctaggactagggcaggaaatacacaggatgagtctagaacatattgtaaatgccagaaagtaaggaagagctaggggagggggcaggaactgctttaatatgggagcatgtccaagggacatatgggggccacctaaaagatctcccaatggtcaaagctgaaacaatttgaacaacaaaataaagcagtgttggattataaccaaaagtacaaaataaacattcatgagtgcatattgatataaatgaattaataatgaattaataaatggaggagaagagacaaatctccctgcagaataaatttcaagcaatttatgtagatactctgtcttaaaggagagagtgcctaactctctacttaaatgtgggccatgcataggacttccttccaaagagtacagtatggcaaggggggaatgaagtaactttacaatggaaaaaatctgaaaaacacagccagatcatcaaggccaacatcaacagtaaaacatcatgttaatagtattgtcccttgacaggatgtgatgaaaatgtcatttaacctctgtggccatcctctcaatatcttataactcctgtctaatcatgagacgtgattagaggaaaatcatgagacaaattttaactgtggcatcccacaaaatactcaatgagtaccctcaaaactgccaaggtcatcaaaaatggcctgagaaaatgccacagccaagaggagcctaaagagccctattattaaatgtaatgttgtatcctggataagatagtggaatagaaaaagggcattaggtgaaacaggaaatctaagcaactcattgactttagctaacagtaatgtagcagtagaggttcactaattgtaacaaagacataccaatgtaagatgtgggaaactggatgtggggtatatggggactctctgtactatcttctcaattttcctgtaaatctaaaactgttttagaaaataagaccaccaggccgggcacagtggttcatgcctgtaatcccagcactttgggaggctgaggcaggtggatcacctgaggttgggagtttgagaccagcctggccaacatggtgaaaccctgtctctactaaaaatacagaattagccaggtgtggtggcacacacctgtaaccccaggtactcgggaagctgaggcaggagaatcgcttgaacccaggaggtggaggttgcagtgagccaggattgcaccactgcactccagcctgtgtgacagagtaagactctgtctcaaaaaaaaaaaaaaaaaggaatccaaggctgggcatggtggctcatacctgctgaagcccaggagttcaagaccagcttgggcaacaaagcgaaatcctgtctctacaaaaaattaaaaagttagctgggcatggtgacatttgcctatgatcccagctacttgggagggtggggtgggaggattgcttgaccctgtgaagtcgaggctgcagtgagccatgattgtgttactgtacttcaatctgaacaatagaatgagagcctgtctcaaaaaaaaaaaaaaaaaaatgcagttgtgggagcgagggcagtatggatgaccacgcttggctatgagctgatcactatggaagctgggtggcaggtgccagagctgaatgagaggaggaggagcagtgtgcgggtgcagaggtagggcaggagaagggatttcaggaggagcaatgggccttcggcctccctgtgcctgcagagggctgtctcctgaagcctcatgtgtggttattcagcatctgggaaactgttccctcaccaagccctctcctctgttcctctgtcactatctccaaggttgtccttatgccattctccccctgtgttatggtggactgtgcatgctccttccctccactcacaccagcctgtatgtcctcagggctgggaaggtcagtccagtactgtctgggaggtccagtccctagcacagccctctgtcaatgctgattattttttagctcttagaaatttcttccttttgtttagtaaaacattgcctcctacaactttaaactagctcctctcctctccctgccctgttccccaaaacagaagaaatccacttccttagcatgtgatgcccttaggtatttaaagaatgctgttttgtttttcattcaacatttatgtagccaggcacagtgccagtgttccgttaattattttcatattcacgcagagtggcctccattccttcggtcattcttcaaggggcgtaatttccagccttccagcctattgctcctcctggaaagcccttctgcctgccccacctctgcgcccacacaccgctcctcctgccactcagctctgtcacctgcctcccagcctccatagtgatcagctcacagccaagcgtggtcacccacactccccctgcccccactactggattcattgttttagtggtcttattttttagaacagtttttagatttacagaaaaattgagaagatagtacagagagtccccatatgccccacgcccagtttcccctgttattaacatcttacatttatacgtctttgttagagttagtgaaggtggtgtctgcttcacttcaatttattaatgtttcagagtaaggtgctcagagatgaacacagggcactaagggacagggaggcctgggcaggatggaggcacgaggatggaaaaggccttgctcagtttggtaggcagtgacaggaggggaggctgtgtcaggaacaggaacaacagggtctgttttgtccaggccctgcaatgctggaacagggagtaaggccttgatttcctagaagtcctggaaggctttgggtggggacttagcacaaggacctggctgctgcttcccacatagggccagcacatagaaagccttcaacaaatatttgttaacatgacccctttgaagaaaatgtctgcggatgccttcgtgaggtgcctgtggtaggactctgagctccctgtgttgaggccctggcttcagctgtaggagaatgagagtggtaactgcttgactgaacccgccccctggaaggtgggtcacatcgtcctcacccttgggagtagcagtgtggagctgggtcagccctgggagcagcagagggtggggcctagggtggagggacccaggttttgagccaggagatataggaagtccaacttctccaaggaacaggcaggctgaggcctctgaggtggtcaagactgggcaggccagagccatgggcagcgcagaagagaggtggcaagcagcatttcttattttcattctgcttctaatagttagctgtgtggccacgggcaaatcactttccctttctgaatctatgtcatgggaaaatgaggagattcatctgggtgagctgccacctctaaagttgtgtggctccatttgggtcactcattcagcagatattccttgagcacctaccatgctccaagcatggaacaaagtgccattgtggctgagtagactgacgtaattcctgcccttatggggcttatgatctagtcaggacagacaacaaacagataactagtaaatacatagaaagttacaaattgctgttaggaatggaatgaaaagcagggtgggtggggaggttcttaaatggggtagctaagggaagtctgctgtgaggaggtgatgtttaagctgagacctgaatgatgaaaataataagctatgggactgggcacagtggctcacacttgtaatcccagcactttgggaggccaaggaaggaggatggctgaggccaggatttcgagaccagcctgggcaacatgatgaaaccccgtctctaccaaaaacaaaaattagccgggtgtggtggtgcacacctgtagtcccagctactcgggaggctgaggcaggaggatcccttgagcccaggaggctgagattgtagtgagctgaaatcatgcaactgcactccagcctagggacagagtgagaccttgtctcaaaaaaagaaaaaaaaaaaaaaaaaaaaaaagaataagctatggaacgacctggcagaaaagtgttcaagacagacaagcagcaagttcaaggttcaaggcaggagggaggaggcgtgttggggggattggaagggagggcagggtggctggaacagactaagcaaggcagcagtgacatgaggctgagatggagggcttggaagggtgagacagcccaggccttaggcggcatgagatttatttgatcccaggtgctttgggatgctgtttgaagcatctagccagagaagcaactgactccagctgtgtgcatgcagcaagtgggttggaggtggctgagagagcaagcaggacagcagtgctcctgagtggatccctggttcaaggttgggctctgccactttatgtctcattaccttgggcaagctacttaacctgtttgtgcctcagtttcctcattgtagttgctgaaagcacagactctgaagacagaccacctgattcaaagcctaggtttattgctttcctgatgtgtgatgttagacaatttttcttttctttttcttttttttttcttgagacggagtctcgctgtgtcgcccaggctggagtgcagtggcatgatctttgcacactgcaagctccgcctcccgagtttatgccattctcctgcctcagcctcccaagtagctgggactacaagcacccgcaccacgcccggctaattttctgtatttttaatagagatggggtttcaccatgttagccaggatggtctcgatctcctgacctcgtgatctgcccacctcggcctcccaaagtgctgggattacaggcatgagccactgcgcccggccgatgttggacaattttcttaacctcagcatcctcacctgtaacatgagaataagaataggagtcagctcactggattgtggtgagggttaaatgggttatagatgcaaaaactacaaaagggcctggaatttagtgagtgctcaataaatgtttgttggtgctattattaccatttcatcatcattgctattgtaattataagatgattgaccgtggataggtaaatttcctttcctgaacctcattttccacatctgaggataacccccacatgctaggatggttgtaaggtgtaaattcatatatatatgtttcctctccagagtaggagctggctaaagagcagccattctggtttctatgcaagtcctggcattgactaggagggcctttgttcccactgtactcaacatgagagacacacgaggtgcttcatgtcccccagagaactctcacatgtgccatctcgtgtagaccctcagcagcttcagaggaaaggtggcatagctccaccccagtcttgccaaagagagacaaagccagggctcagagcacccaaaaatttgtacgtggtcatatttcaaggtctagaacccaaatggtggaggtggggagggtgttccagatcccacttcacatctcctttcaaattcagaatccttcggagacatgtcgatagatattctcacctgcatttcacaggcgagcaatggcccaggaggtactgtgtgccccaaatcacataagtacaattttaaaatatggaatcaatctaagtgtccgttaacagatgaatggataaggaaaatgtgggacatatacacaatggaatatcattcagccataaaaaggaatgagatcctgtcatttgcagcagcgtggatggcactggaggctgttatgttaagtggaataagccaagcacagaaagacaaatattgtatgttctcactcatatgtgggacctaaaaactggatctcatgaagatagggagtagattggtggttaccagaggctgggatggggaggaagagagggaacgaaaagaaagaatatgcatgtatttatttccagtgaactgtatgcttaaaaatggtaaagatggtaaattagatgtgtatattgtacttcaacaacagcaacttggatccaggattagtcccaaccccatgtgtcctccacagagtgggcctcttggtttgtggccctttttcttcttgagccctatacagctggcattggtggctctggggccactaaccgttcctgcccctgcccctccttgcctgagccttgattaacagctgagaggctgaagactgagcactggattgggagttcagcaacaaggattctagtcctggctctgcctgtcccaggtgtctccttaaaaagcggattgcacccttcatcacggaagcaagtatgcctgtggacttccatctcccttccagatagaacaaagtaggaattcaagccaaggaacaggagggcagctggagagaggaggacctgtggccaccgaagtctgtgagggatggaggagaaacagaggcctgcaggaaagtgtggggtgggtggctgcaaagataaggtccagaagaggactggctgtttgattttttattttacttttttttttttgagtcacagtttcactctgtcacccaggctggagtgcagtggcacaatcttggctcaccacaacctctacctctctgattgaaatgattcccctgcctcagcctcccaagtagctgggattacaggcaccggccaccatcaccatgcccggctaattcttttttttttcttttttttttttttttttttttgagatggagtctcgctctgtcgtcaggctggagtgcagtggcgcaattttggctcattgcaacctctgcctcccaggttcaagcaattctcctgccttagcctcccaagtagccggaactacaggcacgtgccaccatgcctggctaattttttgtatttttagtagagacgggttttcaccgtgttcgtcaggatggtcttgatctcctgatctcgtgatccacccgcctcagcctcccaaagttctaggattacaggcatgagccactgcgcccagccctaatttttgtattattagtagaggtggggtttcaccatgttggccaggctagtctcaaactcctgacctcaggtgatcagcctgcctcagcctcccaaagtgctgggattacaggtgtgagccaccacacctggcctattttacttttttgggatagtctctcgctctgttgcccaggctggagtgcagtggcgcgatcttggctcactgcaacctctacctcctgggctcaagaaatcctcccacctcagcctgggactacaggcatgcactatcacatctggctaacttttataatttgtgtagatatgtggtttcaccatgttgcccaggctggtctcaaactcctgggctcaagtgatccacccgcctgggcctcccaaagtgctgggattacaggtgtgagccactgcacctggtgcctagctgtttgatttttgttgtaagtcctaaggaagagaaaagagatttgctcgacaaaaacaaaaacaaaaacaaaacaaaacaaaaagctgtaattggacattggggaaaacttgagagcaatagtggcagtgagattgctggagtgggacagtgggtaatctgatttaggtgctcttctaattccacggttagaggaattccatatgatgtagcaaaaggggcccaggatttctcctgcctgtcatttgctcagtgatcccagataaattcacctcctgtttgaggccttctttttcccatctagaaaatctgtgggtaggctgggcacggtggctcacgcctgtaatcccagcactttgggagaccgaggcgggtagatcacctgaggtcaggagttcgagaccagcctgaccaacatggagaaaccccatctctactcaaaatacaaaaggtagcgcatgcctgtaatcccagctactcaggtggctgaggcaggagaatcgtttgaacctgggaggcagaggttgcagtgagctgagatttgggccattgcactccagcctgggcaacaacagcgaaactccgtctcaaaaaaaaataaaagaaaaaaaagaatgaaaatctgcgggcagacctggccagtctctgaggtctaactttctgtgacttctcccgagggtcttcaccaggccttccttccagagggtgaatgcgacacacgacccttgatcctgatgagcctgggaaatgagttgatacggataaggaaggaaatattttatgaactgattgacaatgatgacgagatgataaaaaagttgttaaagctcaatattgcattccccaggtcagtactggaaatgtgcgtaagtcccatcaggtgaaatgaacaatttttcacctgttattttagtaaaagaaggaaaaatataatacctgttgctgacaagggtgaaatgaaactgggagttgttggtacactctagataggctcaatccttttgataataattttagcattacatttcaagtgctataaaactgtcccaacactttgagacagagattcatctgtgaatttatagagccgaaatatggagaaagccctgcattaagatgttcattgcagggttgggtgcgatggctcacgcctataatcccagcactttgggaagctgaggcaggcagatcacttgaggtcaggagtttgagaccaacctggccaacatagtaaaaccccatctctactaaaaacccaaaattagccaggcgtggtggcacatgcctgtaatcccaactactcaggaggctgaggtaggagaatcgcttgaacccgggagacagaggttgcagtgagctgagatggcatcactgcactccagcctgggtaacagagtgaaactgtgtgttaaaaaataataaggctgagcgtggtggctcactcctgtaatcccagcactttgggaggccaaggcaagtggatcacctgaggtcaggagtttgagaccaggctggccaacatggtgaaaccctgcctctactaaaaatacaaaaattagccaggcatggtagtgggcctctgtaatcccagctactcgggaggctgatacaggagaatcacttgaacctgggaggcagagtttgaagtgagccaaaattacaccattgcactccagcctgggtggcagagcaagattccatctcaaaataataataataataggctggacgtggtggctcatgcctgtaatcccagcactttgggaggccgaggcaggtggattacctgaggtcaggagtttaagaccagctggccaacatggtgaaaccctgtctctagtaaacatagtctactaaacacaccaccgggtgtggtggcgggcacctttactcccagctactcaggaggctgaggcaggagagtcacttgaacccaggaggtgaaggttgcagtaagccaaggttgcacctttgcactccagcctgggcaacaagggcgaaatctgtctcaaacaaaaataataataataaaaaataaataagatgttcatagcagccatattcataatagaaaaacaatgacaacaacattgatgtgtgccacactaaggggatagtttataaaattgtggtatattctcttgatagaacataattgttttatttaaaaaatggtaagcttaatggctctgtaacagcagggtaaaatgggtgatataatgatactggaaaagggtggtacagaattgtacatgtgctatgactatgcctttataaaacacttacccgagagaaacctagaaggaaataagcaaaaatgacaatgcctatggtaagagtcgttttctctgggaggtgagactaaaggggactttctggttatatattcctctcatgttttattttatttttatttacttatttttttgaggcaggttctcactctgttccccaggctggagtgcagtggcacaatcatggctcactgtagccttgaccttctgggctcaagggatcctcccacctcagtctcctgagtagctggaactataaatgtacactacaatgctcagctaattgaaaatttttttgtagagatgggggtctcattacgttgcccaagctggtcttgaaccagtcctcctgccttggtcttccaaaatgctgagatttacttttataattattaaaaataaatatgtatcttgaaagattagataattttttttttactttttcatagtgtccaaattttctagagtgaatgttaatgcttttataatgggaacaaataacttttttaagtgtaaaaattaatttattgcccagaccagtggtctcaaaactgtttccatctcacactgctattactaaaaagtgttcaagcatgtactccctggtatgtatatgtaatataaataacatctgttaatttgtttttattatatccacatataatattactgtaccaatatatattataaacatataaaaattgatcttttaaaagaaaaagagaaagataaatataaatgaaatcctactattcacatactctagtggatcttgtacatctccctgggtgacatgtctctccaccccggctttgttttgtgtgtgtgtgtgagagatggggtctcactctgtcatccaggctggcatgctgtggctgaatctcaactcactgcaacctctgcctcccgggctcaagtgatcctcccacctcagcctccccagtagctgggacaacaggcaggcgccaccatgcctggctaatttttttgtattttttggtagagacggggttttgccatgttgcccaggctggtctcaaactcctgagctcaaaggatccacccaccttggcctcccaaagtgctgggattgcatgagccaccgcgcctggcctccacccccacttcgggaccaccaagctagactcccgcaagtcttatcacgggttcctccccttcagtctcctgcctgctggattctttctgcacactgtgttcttgttaaaaccctaatctagttgtgttaaactcctgcttgaaacctttcaatggtatctcactgcctataggataaagtccaaactcaatgctacctcaatgacccaccacagtctgacaccccactcaagtcccctccagcatctcctgccacctccaactcactccagcagcccaggcgggttgcctgctagatgctgcacataccttgcctttgccaatgctggcccttttgcctgaaatgctaaccccagtcctgcctccaccctttgtgataaattcctgctcattctctaagattcatcttctgcagcaaacctcctcagactaaccccagtttgggataagtaccccctttctgcacactcataatattctctacacagctctgtcattgaccgtatcgtgttgtcatacagttacctgtttgcacagctctttcccttccacctgattaagtgcttcaggaaggcaaggctgtgctttatccgcctttggtctctagcacctgtacagtgcccagcatgcagaaggtgcttaataaatgttgactaaatgtgatgggccatactcattgcagaagattgaaaaacactgaacagcaaaaaaagacaaaacccaaatcatttgcagtcttccagcaatcccagttagcatcttctgtatttccttttagtgttttattcacttcgtgaatatgtgccaaatatgcctttattgtcatactctgttttcataatggagctcatacttcttacacattttctttacttgcggtgatattgtggtcagatacggttttggcagcaggtgtgggaagcgagtgattccaatggtagagaaagggggtatgaaggcagacagagctgcaggtgattccagccctggccaataagcacacaaaaggctctgacgtgagatcttcatgaccttgagcagtgtgaggtcttcatgaccttctctaggcttttgactccaatcagcaaaacaagaaaattagagtagatcagtattttttaaagtatgaacatattccacaggagggttacaggatgattttaggtggctcacagattgacgtttttagttttaacatttatgtatttatttatgtgaattagaaaaagcagcatgactaacttactaactgtgtgatctgacagatcttgttgcttaagacaaagttaaagtaaatatttaagtaaaaggaactgaacagattgaaggaaaatcatttgtaatttttttttttttttttagacagagtcttgctttgtcacccaggctggagtgcagtggtgtgatcttggctcactgcaaactctgcctcctggcttcaagtgattcttctgcctcagcctcccaagtagatgggattacaggcgccgccaccacacctgactacttttagtagagatggggtttcaccatgttggccaggctggtctcgaactcccaacctgaggtgatccgcccacctcggcctcccaaagtgctgggattacaggtgtgagccaccgtgcccagcccggaaaatcattaataaatttaaagagcagatgatatgtagataaggccaacactggggcagtcttgtgagaaaaacaagctgaaaaatactggcggttccttctggttcaaggatgccacacttctctgattcctgggtattaccaatataggaaatggccatgtagacctgccactcaaaaaagggtttaaggagccttagctccttgcatattgcctggcacatgatggggatcagttaatatctgttgaatggaaattcataaaaggtttacatagagttgagtgggggcagatggaacattcagcatccgccctgctcagtcagcatttgcggccctcatctagaatgctgacccacagaattctgtcttattcattaatcgttgaactcatgcctttctagactgctaaaacaggcagaaaacatatccattatctagctcaaatccctcacgttttaaccgaagactctgagatcctgaagatcacagagccggtggcagaggtacctgtcctgtgaatagcgcaggctggttatcctgaaaatcacccctacagagcacagggcggcccatgtggggtagaatgcatggctgcatccacaagaaagtcaggaaatccccaaggccaaagtgaagaggatcacccaaaacagacagacagtatgaactaatgctggggattgcccaggagggcttaagggcgtcacgggctggttttttttgggacggagtctcactctgtcgcccaggctagagtgcagtctcgtgatctcaggtcactgcaatgtccccccactgggttcaagtgattcttgtggctcagcctcctgagtagctgggattacaggcgtgtgccaccacacctggctaatttttgtatttttagtagagacagggtttcaccatcttggccaggctagtctcaaactcctgatctgaagtcatccacccgcctggtctcctaaagtgctgggattacaggcatgagccaccgcacccagccatgggttgattttttaaagcctgaaaggacagatgcagctttcagttcaagtgagacaggggattggaactgagacccctgtgtgaagctgaggctaccctgttcagtgaaaaagtagactagaaatcaatgtgaccatcagcatcaggaagtgacatggagtcttgtctgtcctagcttagaatctaggttaaaaaaaaattatcccctaagaattagtcatcacatgctttccccctcctaggttttggtgaatcccttagcctcaccccaatttctatgtttctgaaatggagtggttgtgaaaattaaatgagttcacaaatgtaaagtgcttgacacatggtaagttctaagtctgagtgagatgttgttgttatttattatgtaagaaattgagagttaatggaactttttaagtgaggactacccagtagtgtgctcatggatgtttaacaaccagctctccaagatgccggaggaggaccctggcttgcagtgtttgctgatttccatagtgtaaatactcccaccatggccagtttcaaactaccaacctgctgccacaagcatggagttgagaagaggtgcacacggtcagctttcatgagcgggtggcagctggctttgtcatattgctgatgctacaggactagcttgtagccatgctgacctctgagttttttcttaagccaatctctatggatcaaagttgactttatctttgtcgatataatctggctggaagaatgaatgttctgacttgttaatgatgtattcagcttgtctgcttaggtaagagagtacaggtgagttagttgaagctttataccaccttgccttgctgtggtctcaggaggcctcagtccttcttccaccttcctcagccgcacttactatgaggtgagggggagggcagagccagaccaccatggccagtccaaggcagccaccagtctacctcctgtctctacagacctgcctgtgctggacatctcacgtaaaccgaatcatgtaatatgtatataccacactttatccatttatcaatataaaatgattaaggagctattttactttctaagttctgtgttctaagtctgtgaaatctggtgtgtattttacactcacagcacatctctatttcagactggctgcatttcaggtactcagtagctacaggtggcccattgctactacatgagacagcacaggcctaagggaagaaaactgtggaaagggaaagggtgcagaaggagagtctgggagggtcagagaagcagaatgaagcgccacatgcttagggaggggagagtggcaggaggcaaggctggaggggcgggactggcatgagaacctcggcttctgtgcctgccctttagtgatgaagatatgtgccagaagttcctccagcagaacagctggaatatctttcggaaggacctgttgcagctgctcgtggagccttgccaaagtcaactgttcactccaaaccggcccaagaagagagagatctacaaccctaagtctgtggtcctggatttgtgcagcatcaacaagacgactaaacctcgttatcctatttttatggcaccccagaaatacctccccccattgaggattgtccaagccatcaaagcacctcggtacaaaatccgagaactcttggcttagtgtaagagcacaggggtccttatttaggacaaataaaggatggtggattgggcgctgtgctttctgaatgaccaccatgggagctgtgggacttggaggaagggggcctggagggctgagctgtgggtccacagaggtgtttgggggacagcaatgggggcacagtctcccttgatgcttgagggctgggctgagtgaatggatggtcagaggctgtgtgtggacgggttaatcattgggcataggttcagggtaggagggtcttgtctgataagctggatgtgggggaggctcaaatcaaagtggtcaagactagggttgcaaatgccttccaaggccacacaggtcatctaaaggagggcagcagaagggctgggaaggcaacggggaatggtggagatgctggggcccactgtgtaagttccccatccagatggggcagctgccccttagcccagtcagttgctgccctgtcagaaaataattcgggcctcatatcgtcagtctgtagattcttcaagagaatcaagaaattcaatattttagatgattcctaccagtttttaaacatgagcaactaattcagattgttttcaaatagtgtcaaacaaaacacacatgggcctgcaggtggtgggctgggtccctgtcagagagtggaagtgaggctgcgactgattgggaggagggtacaggagccagagagacgctgatgggacagcatgacaggagcaggcatcaggtccaggatgaggagtgagtagctgtgatagaggaggtggagacaaggaggctgcagagtctgaacgaaagagggctcctcactctctctgctgggtctttaatctggagctgcccaacactgatctgggcctacaactcagggttcctgtctccagcagcctcagcaccacagaccaagctccagacacctctttcccttcgagaaccccataggttagcctgagagcactgaggagcctggcggaggccatggcggcacaggagcctgcccgcttccaagtcccccaccctgtccctggcaaggcatagactctgaggaatgcctgggcgttgagctgggcaccaggagctctggcagtcccaggtgtgcttgtgtctcactggaccctcttgagcactttgattcccttatctgtacctcagtttccccagtggtgaaatgagcaagttggacaagatcaatggctttcatgaatgggggtgatctagtttgaaaagcatattcaacattatagttttgtttgttgaatttattttttattttgagacagggtcttgctctgttgcccaggctgcagtgcagtggcacgatcatagctcactgcagcctcgaactcttgggctcaagcaatcctcctgccttagcctccaaagtagctgggagtacaggtatgcaccatcacgtagggctaattaaaaatttttttttgtagggacagggtcttactgaattgctcaggctggtctcaaactcctggcctaaagtgatcctctcaccttggcctcccaaagtgctgagatttcaggtatgagcctgatacgatttggctgtgtccccacccaaaatcttatcttgaattgtaataatccccatgtgtgaagggcaggaccgggtggagataattgaatcatgggggcagtttccccatactgttctcatgatagtgagtgagttctcacgagatctgatggttttataaggggctttccccttcgctcagctctcattctctctcctgctgccatgtgaagaaggatttgtttgtttccccttctgccacgattctaagtttcctgaggccttcccagccatgcgaaactgtgagtcaattaaacctcttttctttataaactacccagtctcaggtatgtctttattagcaatgtgaggacaaactcatacagagccactacactggaactctgttgaatttaaaagaaagccgttttcatattgcataccagaaaagaagtatgaaatttttctctctgaagggggtgtggacgtaaagggtaaagaagcagtggacttacagatcttcacttccctgatagctccagaatcaaggagtcagggatatctgcagcagtcctggaaaggttgactgtgacctacaaggacaaggggtcactgttttgggaccaagtaagttggggtgtctgaccatatttaggtatccttttgcatttagggctgtggctccaagatgatggtgtgggcttcttattcatccatttgaaatttatttatttatttatttatttttggagagagtcttgctttgtcgcccaggctggagcacagtggtgcaatctcagctcactgcaaccttccggattcaagcgattctcgtgtctcaggctctcaagtagctgggactacaggtgtgtgacatcaggcctggctacagacctggctaattttttgtatttttagtagagatggggttttgctgtgttgcccaggctagtctcaaactcctgagctcaggcaatccacctgtcttggtacttccaaagtgctaggattataggcgtgagccactgtgcccagccttgaaatttatttattgagcactgcagagagagtcaaaggttggataagatgcattttctgttgccttttattttcttggctaggggtcaccaaactccttttaaattttatgtttttaaatttatttttgagacagggtctgtctctgtcacccaggctagaatgcaatggcatgatcatagctcactacagcctcaaactcctgggctcaagcgatcatcctgcttcagcctcttaagtagctgggattacaggtgtgcactaccatgcccgactaattttttttttttttttttttttttttgtagaggcagggccttgctgttctgttcagattagtatcaaactcctggcctcaagtgatcctcctgcctcagcctcccaaaatgccaggattacaggtgtgaaccactatgcccagcccaaactctttatgtaaggggtcacatgttgagcacttattacgtgacagtcaccttgctgagcatctgactgtggagttcagtgacctgcaggctctgccacttaatggctgttgaggattaaaagaggtggtatgtgtataacaaggtggaagatttttttcaccaagatctctgggtcctgcttcctgggaaataagaaaatgcggccaggcacggtggctcacgcctgtaatcccagcactttgggaggccgaggtgggcggatcacgaggtcaggagatcaagaccatcctggctaacatggtgaaaccccgcctctactaaaaatacaaaaaattagctgggcgtggtggcgggcgcctgtagttccagctacttgggaggctgaggcaggagaatggcgtgaacctgggaggtggagcttgcactgatccgagattgcaccactgcactccagcctgggcgatgagtgagactccgtctcaaaaaaaaaaaaaagaaaaagaaaatgcttccagaataacaggcagaacatgttttttagggcagtaatgggtgagaaaatagcctggaagagcaactgaggatgagggtactgagaagggagagagactctgggctgggcttcaggaggtcttgaggggagctgaggaagagcaaagttcctgaagccactatgtgacaaaagaacttgagaaggagaaatgtctgaagaggacttcaaggagtcctctgtgcttttctgtgcattgagaatgtgtccctctttggcatttgtttgagaaaccaagtgaacatttgaatagaattatagaattaggcagtactgctgtctctttgaatccagtaaccaagcagggagtgggcagcaagagatgcttattatattcagcatatggtgtaaagtccctggcatggtaagtgctcagcactcgctaagtgtcattcacgtcttttagaccaaggtcaatttgatcatctagaaactctcttcccccttcagtggaataggaaactgagactttggaagtctgagccctcataatcagtgataaaggccatcactgagtggattggggtaggaggagcctgaatgacttctcgcctaacccccacactcttatctaggtgaaggagctcatgggaacatgaacgggcagcctctcaggggagagtggagacagggcagcaaaccataccaagcactgtgtggggggggtactgtttggaaaaagaatgagtgggacagtgaggggaatgtagggcagggggaggtgggacttgtgtgtgagcctagcttccaggctgtgagctgcagaatgagcgccggttctcaaggttccctttccccagcacacacacacacacatatacatacacacatatatacacacatacacatgcatacacacatatacacatacacatatacacacatacacatatatacacacatatacataaatacacatatacacacacgacacacatacacatacacacatacacatacacacatacatacatacacatgcaataacatgggatcagattcaggcaggatactgggtgtgctggctcacgcctgtaatcctagcactttgggaggctgaggcaggagttcaagaccagcctgggaaacatagtgagaccctgtcactacaaaaaatacaaaaattagccatccatggtggtgcatgcctgtagtccaagctacttaagggagctgaggtgggaggattacttgagccgaagaggtcaaggctgcagtgagccatgatcatgccactgtactccagcctgggtgacagagtgaaactctctctcaaaaaaaagggaaaagaaagaaaaaagaatcaggcagtgggcagtggaagacatgacatgagcatttacctgggagaggagttcactcagaaggagtaaatatgataccccctggcacaagtgtttggaacaaatgacattttcagtgctgcagaggtcctcactgccacctaggcacagatccaagggtcccggaagcccggggtgatctgccatgcctaagaagccagggagagggccccaggctcaggtatggagtacctggtgtgtgccaggcattatgtgaggcactctacagaggccatcacttactctgaaactatttcctggcagctaactggatggcagcatccatttgagagatgaggagcctgaggccccgaaggcaaagctcactcagctaccaggtggtggttccagaaaatccaggaaaaccacagcccagcaccctcctagttaatcagcattgaagtgtgtggacagttacaccaccgttactcatctatcccaaatgagccacctattttcaaaaaaggaagtctgcacacacagccctgaaactgtgctggggagaatataattgccctctggaattattttccatatgtaaataagcatagtcatacttagagaggcaagcccaagctgcttgagccaaaaatatagcccctagtgctaaaagcttccactgtttgggggaaaaataaaaaaaacccacttgaaaaataaacacaggacacattaccagcgtttgttataggtagtgtttaaggtcccaacttggggttggaagaaaggcattgtttaaatcttctattccggtggggcgcggtggctcatgcctgtaatcccagcactttgggaggctgaggtgggcggatcacaaggtcaggagtgcgagaccagcctggccaacatggtgaaaccgcatctctattaaaatataaaaaaaaattagctggtgtggtggcgggcacctgtaaccccagctactcgggggactgaggcaggagaatcgcttgaacccaggaggcagaggttgcagtgagccaagattgcgccactgcaccccagcctgggcgacaagagcaagactccatctcaaaaaaaaaaaaaaaaagaaaagaaaagaaaaaaaaaaagaaaaaagaaaagtcttctattcctttcatataactcctaggaaagtcttaccttccagttaaggggtgaaatgggtcactttgctcatctgcaaggctacatcatagggaaatactttcagggcagtacacgtacaggccattttaccatgatgcctttctactgctgggggatttatggggcttaactgcaagggtgctgagttgctgaatttgtaatcactggtccagagcaaacaatgaggatgagtagcagtttctaggtggctgataagcaggatcaaagcataaacaaaggtttttcatggctgctgccaaactgtgggccttggggacagacactggagggctggggcagtgagaggtagcagagttcagatgtgtgctgtgtgactctccgccaggctccatccctttcctgagcttcatgcctagcatctgtgcaattccaggggtccagcgggtgttctgcacacatagcccccaccccaggggctgagcagggccccacccgcctctcttgttttgtcctcacctatctcgtacttccaaaaccacccacccccaacagaaagtcaggatcaagaaagtggattattgaggctgggcgcagtgcttatgcctgtaatcccagcactttgggaggccgaggtgtgcagatcacctgaggtcgggagttcaaggccagcctgaccaacatggagaaaccctgtctctactaaaaatacaaaaattaaccgggcgtggtggcacatgcctgtaatcccagctactcgggaggctgaggcaggagaatcacttgaacccgggaggtggaggttgtggtgagtcgagattgtgccattgcactacagcctgggcaacaagagccaaactccgtctcaaaaaaaaaaaaaaagaaaaagaaaatggattattgaaccccatggtggcatgtgaaaatgaactgtgggagagataatagtatttatttatttatttgttatgttttcccagatagggtctcactctgtctactctggagtgcagtggtgcaatcacggttcattgcagccttgacctcctgggcttaagggatccttccacttcagtctcctgagtagctgggactacaggtgtgccacaatgcctggctaatttatttttttattatttgtagagacagggtttcaccatgttgcccaggctggtcttgaactcctgggctcaagagatctgcctgcttcagcctcccaaagtgttggaattacaggtgtgagccaccatatctggccgtaattgtatttcttgctgtctgtaattgtactgttacgtaagagactctccttgtacttaggaaatatacactgcagtacttggcagttaagagagataatttcttcaatttactttccaaattatttagaaaattataatatgtacatttagagagagaatggcaaagaaaatatagtcaaataacaactggccagtctgcgtgaagtgtacttaggaattgtttttaaaaaaaatttttttttaacagaggtggggtctcactgttttgctcaggcctgtctcaaactcctgggctcaagtgatcctcctgcctcagcctctttttttttttttttttttttttttttgagacagagtttcactcttgttgccaagactagagtgcagtggcagatcttggctcactgcagcctctgcctcctgggttcaagagcttctcctgcctcagcctcccgagtacctggaattacaggcatatgccaccacgcctggctaattttgtatttttagtagagatggggtttcaccatgttggtcaggctagtcttgaactcctgacctcaggtgatcgaaccacgttggcctcccaaagtgctgggattgcaggtgtgagccaccgtgcccagccactgcctcagcctcttaaagtgctgtaagccgtcgcctggccttaggagttctttgaaccatccttgaaattaaaaacatatgtttaactgtggtaaaatacgaatagcataacatgtatcatcttcatcatttttaagtgtatagttgagtggcatgaagtattctcattgttatgtaactatcaccaccatccatctccagaactcttttcatcttggaaaaatgaaactctgtacccattaaacaatgactccccattactccttcccccctagtccctggcaactacctctctcctttctgtctctatgaatttgagtaccctaggtacctaaagtagtggaatcatacaatatttgtctttctggggctggttcatttacttagcatgctgtcctcaaggttcacctatgttgtagcatgtgtcagaatttcgttcctttttaaggctaaacaatattccattttatgtgtatataccatattttgtttacccattcatctaccgatggccacttgggttgcttctactttttggctattgtgaataatgttgttatgaacattggtgcaaatgcatctttgagaccactgctttcagttcttttggttatatatccaaaagtgggattgctagatcctatggtaattccatttttaattttttgaggaactgccatatttttcatagtggcattatcattcttgcaattttaagtgtgaagttatcttaaaataaaaattagaactgaaaaaaggaagaaagtgaaggaagctaatatggatatgcataaatattggctttagttgactttataattagataaaaattgatttttaagtttgttgaggccgggtgtggtggctcacacctgtaatcccagcactttgagaggctgaggcgagcagactgcttgagttcgaagttcaagaccagcctgggcaacatgatgaaaccctgtctctacaaagaaatacaaaaattagccagatgtggtggtgtgcacctgtagtcccagctactcaagaggctgaggagggaggatcacttgagcctgggaggtggaggttacagtgagctgagattgcagtgagcctgggtgacagagccagacccagtctcaaataaaaaaaaaatcattgataagctccgtgatattcaggataaaaagagaaacatattatttattagaaattagacaattgggccaggtgctttggctcacgcctgtaatcccagcactttgggaggccaaggtgggtggatcacgaggtcaggagatcgagaccatcctggctaacacggtgaaaccctgtctctactaaaaatacaaaaaattagccgggtgtggtggcgggtgcctgtagtcccaggtactctggaggctgaggcaggagaatggcacgaacccgggaggcggagcttgcagtgagcagagatcgcgccactgcactccagcctgggtgacagagcgagactccatctcaaaaaacaataacaacaacaaaaagaaattagacaattgagaccaagaagaaaatggaggaagtcactatggatttgtataagctctagccataattacaaaacctggctttcacacacctattagaatagccaaaatccagaacactgacaccaccaaatgctggcaaagatgtggaccaagaaccatcattcattgctggtgggagtacaaaatggtacagttgctttggaagacagttcagtggtttcttataaaattaaacattctcctaccacacaaggagttgaaagcatatccatatgaaaacccgtacataaatgtttatggcaactttatttgtagttgctaagacttggaagcaaccaagatgtctttcagtaggtgaatggataaataaactgtggtatgtccagacaatgggatattattcagcactaaaaagaaatgagctatcaactcttgaaaagacatggagcaaccttaaatgcatattactaagtgaaataagccaatctgaaaaggctacaaactggatgtatgtccagttatatgacactatggaaaggcaaaaactatggagttgtcttcaaaattagtcgttgccaagggctgaggagagggaaggatgaatggatatagcacagatgatttttacagaagtgaaactacaccctgtaatactactactaatggtaaacccatgtcatcatacatttgtccaaatccatagaatgtaaacttcccagagtgaaccctggtgtaaactctgaccctgggtgataacaatgtgtcagtattggttcctcaattgtaacaaatgtaccactctggtcgcggacattgataatcagggggctgtgcatgtgtcgggaacagggagtatatgagaaatccctgtactttccactcagttttgctatgaacctaaaactgcgatagaaaatagagcctgttaaaaaaacaaaacaaaacaactggctttgagctctctgatggctcaacatggtgaaaccctgtctctactaaaatacaaaaattagccgggcatgatggcaggtgcctgtaatcccagctattcaggaggctgagacaggagaatcgcttgaacctgggaggtggaggttgcagtgggccgagatcgtgccattgcactccagcctaggtgacagacagagggagactctgtctcaaaaaacaaacaaacaaaaaacagttctcaccagcattcacacattgctccattatccacatcctcatcagcttcgatgatcatcagctcatggggtttgccccctctgcgagaagcatcctggagcccattggctgctacctgctcccctccctccaaacagcgcttgtcttctgtccatctcagtcccctcaccttcaggctcctgggcatctccatgaaacagggaggcctaggagagctggcatcactgaatctaaaacctagaagaatccaaccagcacacatgccctagggagaggagatggtctaggtttagagagacagcaccaaacaagatggaacaaagtccctggcctctaggagcttatgttctgtattgatgatgagcacaggaagtgcacaagaaaaatcagggtaggtagggggtggaggctactactttgtgaagggtcattagagaacactttatgaagaatatgacattggtgagtacaccagtgagggagtgaaccctgcagatatcaaggccaagaatgttccgggcagaggaatgttccatgcttggcatggctaggtgacagcaaggaggccagtatgtccagaatggagtcaaaggagaaaaaagttgcaagaaggggggtggaggccagatcatgaccatgtgaagggagcttttggaaggttcttagcagagatctaggatctagaatctggctagactggggaagcaccagcatggaaggcgtcggggaggaaggcactgcagtgatccaagtaggagattatggaggcttggatcagagtggttgtggtggtgttgagatgggaccaatcctggccatattttgacggcagaactgagagggcttgctgttggactcaatgtgaggaatgggagagaatcaagaattactccagaaatgttttttgagcaagtggaagctgcttcctgagataaggaaggctgtgagggaagcacagttgggggtggatctcagaagtgtggttttaaacagtttacagcaaaaggatttaaagatgaagtgacctaatatacattaaaaacttaggacaggacaggcacggtggctcatgcctgtaatcccagcactttgggaggccgaggcaggtggatcatgaggtcaggagttcgagaccagtctggccaacatggtgaaaccctgtctctactacaaatacaaaaattagctgggcttggtggcgggcacctttaatcccagttactcaggaggctgaggcaggagagtcacttgaacccgggaggtggaggttgcagtgagctgagatcacaccattgcactccagactggacaacagagaatagagtgagactctgtcaaaacaaacaaacaaacaaacaaacaaaaccttagggacagtatttggtacttcatagcacacatgcatgtaaggttgacatttatctccattttaaaaataagattgaagtttcaagggttaagcaacttatgtactgtatctctttgagaccctgctttcagtccttttggatatgcagttgaaccttgaacaacatgagtttgaactgtgtggccccacttatatgtggcttttttttcagtcaaatgcagtggtgggatgccaaactgcagacagggagagccaacttttcatatatacaggttctgtagcaggacttgagtatgtacggatttgggtatacccagggattctggagccaatcccccagtatatcaaggtatgacttgaaagtggcattgctggatcatacggtagttctatttttaattttttgaggaactgtcctactgttttccattgcagttgcaccattttacaattccactaacagtgcataggggtcccagtttattcacatccttgccaacacttgtttttatttttgttttctttttttctttgtttttttttttttttttttttttttgagacagggtcttgttctgttgcccaggctggagtacagtggcatgatctcagctcactgaaacctctgcctcctgggttcaagcaattcttgtgcctcagcctccctagtagctgagattacaggcgcccaccaccacacctggctaatttttgtatttttagtagagatggggtttcaccatgttggccaggctggtcttgaactcctcacctcaaatgattcgcctgcctcagcctcccaaagtgttgggattacaggtctgagccactgtgcccggcctgatttttgttttctagaaagtctcactctattgcccaggatgaagtagagttttgacctcctcggttcaagtgatcctcccaccaaagcctccagaatagctgggaatacaggccatttctttatttctatcagaattggactcatggcttcctgttttattcagtgtgctatcatttgcattatatgagtcattctacattttgatgctcaaattgtgacagatttggccaatggaagccacttcaagctggcttctgtgtccttttgatatgtccccgtcattcttggagcactgtcttgattcctgccataacaggatatttcaagatgatcttgtactttctttgctgcagccctggaattagccatttctccaaggcccatggttccttttagtaaagaaccatgtttagaagcttctggccctggctttacccccgatgaaactcatggctttgaaaggcccagcatctgatctgaagaggcagaacaaaccattcattttactgaggagactgaggcctagatgtggtccattggccaagtccgcagccagtgacagagcttagacacgagctgaggcccctgacctcctgtccagtgttctctgcatggcaatacatattgctagctaagcggtctgctcccagcagggcctggccctctctggacctcacttccctcttgcggccactgagggttatctttgccctgggggtccaggactgcctgagagttgaccttagctcctggctcttgatgcgccttaccttcctggagacttttatgggtgaatccaccttaaattacagaagaggtcctgcttcagcttttatctccagcttacaaaccaatcccatcctgaaatgacttgtcgaagtgcatggacctggggggacacgtggtttgttccctccacgccagggattcaaggaatatgtgcctccctgaagcccatcttggtcagctaagacctgtctcatagaggagcatcaacaggaaagattgggtccaggcctgataccgggttgggaaggcaattggaaaggcctcgtctacctgccctaaggctcccaacccacccaggttacaccatcagcatctggggaaacagagacactaccgtcccacatccggaggccagtgtctcattagcctcacgtcaaagttgagaataagaaccctctatagtcatattctctatatgccattagagaatgtttgctgtgcctgatttggggataggttatgctgcatctgaccgatgccctctggtttggtcagccacgatagcaacttccagcctggaaatgcttgattattcaatcagtgcccttactagtgatgtcacaccaagcagcagtctgaaaggctttcgtctgttgtattcaacagacatttccaagcacctgctgtgtgtcaggcattacgttgcaccgttgttgcagaaattatttaaaccttagctcaatccaagtaggctttcaggtaacaattacgatgcaagtgggctccatccatatacaagaggaacaaggaggggcagcaaaagaaaggccgtatcggccgggggtggtggctcacgcctgtaatcccagcactttgggaggctgaggcgggcggatcacttgaggtcagtttgagactagcctggccaacatggtgaaaccccgtctctactaaaaatacaaaaaattagctgggcgtggtggcgcatgcttgtaatcccagctacttgggaggcagaggttgcagtgagcaaagatggcaccaccacactccagcctgagtgacatagtgagacgccatctcaaaaaaaaggccgtatcttctgacgttcagttctggcactcgggagtgtcaggttcttacaggcaagactttgtggagatactgaatttaagttgggctctgaagaatgattttgccaagtgaaactgtggaaagggcattacaggcagaaggaatggcttgagcaaaccacagaacctgtaaagtgcaaggttatcctgaacagcagagcacctgggtggcagtggctaacacccaggcaatggagggaggagtcaaagatgagaaattccagatacctcagagcccaagcatgaaggagcatgaacctgtgcttctgtagcgtatactaactctattctacaagcaacgagggcttaatacaggcttttaaaataacctttattttttaaaagttagtatgtgcattataggaaattgaaaaacacaagcaaagaacaaagtcattcacaatcacaagcagtttatagtttgacatattcttctagatcctgtgtgtaggcacaacatccaattttatgggactgagactgtacagtatgtatcatgatttttcacacatcatgaatatttaccaattcaaaatcccaaagctatatgagtattctgataaccaagaatacactacaccaactcaaactgctaaaaaaaaaaaaaaagatgtaatcctgcctttcttgggacagaaatttcatataagacaaaaatggcaacacgcctctagataaaagcattggcagagttctgatttaaatgctgcattcccttaatgctcaatttaaaatgaaacacacagcaacagaatacagtatgtttttaagagaattcattagcagatctataccattaaaatattagcaaagtgtatttccattgaattaatgtgttcttatagtacagccaagagatgcatacatcaatggctatcaaaatgtaaatatggacatatatggacacatctgcatacatctctacctgtataattccttctgcccctctgctgccaacctaatgaacaagtcctgacatacactgctcagaggtggcttaacaattccatgtccaagatgtatcctatcaattataacaaaggtatttacaaataggctaattcactagctctagtttttatcataagttgtcaccccattcgtaaagcttagatgttgcaaaataataactttgtccacaatgaacacaggcactttactaaaaacgctcttgtagacctgtggttatcatctaaaaccatcgtctagatatggagatactagcaaagagcccttcccttcacccttcctcttctccctcttccaccatccccgtgactaagtacaggatgtctagctccaaggggtggactaataaaggtcactcccagaggacaggccttcctaaaaactaacaaaaggacattcacaaagggactgatttactacatctatttttaacatactttgagcattaagacttatcctttaatacacaatattaactaaaatgcacatatagaacaatggttagaccatctgaactaatctcaggagcacagaacccctctccctgcatacctcctctgcccacccccccttcccccaccccaaacacccaatgaatagtctgcattcgctcctaagcatcaagttttaacaattccattcccaaatgcaaccactcctaggaagtactgaaaacaaatgcttagaggggtgttacttaagccctctactgttaacctacattgtgcacttttttttttgaaacggagcctcgctctgtcgccaggctggagtgcagtggtgcgatcttggctcactgcaacttccgcctcccaagttcaagcgattctcctgcctcagcctctcgagtaactggggctacaggtgggcaccaccacgaccagctaatttttgtatttttagtaaagatggggtttcaccatgttggccaagatggtcctgatctcttgacctcgtgatccgcctgcctcggcctcccaaagtgctgggattacaggcatgcgccactgcgacaggccgttgtacacttttaaacacctagaaagactagatgtttcaaactggacttaagttttccattatatacacagtagcattgaataaatggtatacatacataacacagactgtaatttgagtgtcttctaaataggaacattctggcctagaacccttccctttcccacctctaccaaccccgtggacagctataagccatctgtaatgcttagggggggttttaacaatttcacttgtttttaagaagtcttccctatgaattttaacacaaagtgtactcaatgtagtagtttactaattctacttttgtcatatactggcaacctttttaacatcgactagacgtaaattaggactcctatgtccgcttatatacactatatacacagcacagtaaatgaaaatgcagacataagggacaatggtcaatgtgcctcctcataaacacactggacactggtagaaagccctttgcactttgtgctcctccttccccctgaaccagcacaaatatcaaaatgggtactgctcagagaattgatcaatttccaagacaatatttcatatcaaaaggatagctacaaaatgtgttatttactacctctacttttaacatactttgtgcacttctaaacatctagaaagactagatgtttcaaataaggacttaagtttgtccgctatatacacagtagggttgaataaactacacacatgtaacaatggttatatctgatagtgtcttctaaatacgaacattctggtctagaacccttcattccttccaactcctctccaccaccaacctgatggatataggcacgtgtcacttagagctgatgttatctcacttccaaaagtccttttcagaagacagcctttctacaaattttaacaaagtgtacaaaatgtgttagtttactaactctacttctgtcatacattggcaacctctttaatatctagagactagatattataaaatcgggactaatttgtccgttatatatacaatatatacagtatagcaaagttaaatgaaatgcatgtaacatatacacaatggattaagctgaaattttctaataaacaatggcaaaacaccatttgcaatttcttccctcccacctcccaggtggttcaacaattccacttccaaacagcatttcccatcagtttttaaaagctatttacaaagtgttattctactaccacttttaaatacatcaagcacttccaaatatctagaaagactagatatttcatataacttgtccaccacatacacagcactgttaaataaaattgcacacacataacaatggttatcatctgaggtatcttctaaatgtggccattttggccttgaatcattccctcctcccttccttctctgccttcaatccagtggacaagtacaggcacgtgtaatgcttagagatggtcaaacaaattcctatgcaaaagtctttacagaagacaagttttcctacgaatttcaacacaaagtgtacaaaatatgctaattttactcctttgtcatacactggcaacctctttaacatctagagactagatgttgaaaaattaggactatttgtccattatatatactatatacagagcaaaacaaaatgcacaaaacatatagaaaaatggtgtctgaaaatgtccaagtatgaacacactagtaatattaccttttgcaatttcttccctcctacctcctctaaactattgaacaagtatagacattactatactgttcacaaaggtggcttcacaattcaatttccaaaagcatttcctatgaattttagcaaaaagatatttacaaagtggtattttactacctatacatttaacatacatcgggcacttctaaacatctagatagactagatgtttcaagtaaggagttaatttgtctactatgtatacagcagtcttgaataaactgcaaacatgtaacaacagttataatttgaaagagtcttccaaatgtgaacattctggcctagaacccttcccatctccatcaacccagaagacatcaaattttcagaagacaatctttcctaggacttgtaaaacaaaatgtacaaaatatattagtttactaactctacttttgtcatacactggcaacctctttaacatccagaaagactagatgttgtcaattaggactcgtctgtcctttatgtacactatatacacagataagtaaaacaaaatgcacagacataatgattcatcttgcctcgctgtaaacaggatggcatagagctctctgcacctccccctcctctctcctcccctgaaccactgcacaaacacaatgagtattactcaacaggtgatttggccattcccccccaaaaatatttcctatgaattgtaacaaaaaggtatttacaaaatgtgattttgctacctctaattttaacatatcaggcacttcagaacatctaaaaagaagagacatttcaaaaaagcttagcattgtcaactatatacacagtagtgaggaataaaatgcacacaaaacaatggatagaatatgaaaatgtcttctaaatatgaccagtctagcatagaaccttcttctcttccttctcaggtcttccagctccatgtcatctaacccacttaacaaacgtggacgtatcgcttccagaggccgtcttaacaactccatttccaaaagtcatctccagaagacatgtattttctatgatttcttttaaacaaatgagaatttacaagatgtgtaactttctaactctattttatcatacgtcggcaacctctttccatctagaagggctagatgtgacaaatgttttctattaaaaggttggggtggagttgagagcagctttttcatattatatacacaggccttccataaacggccagtaaatcttcccagagggtggtgggcatttccaacgggccaaacgtggcctgtcattctaccatttctctcttccgacagcaaagtctggtagaatgaagaccaaccgcccgatggccgctaaccgttccacccgtcgtcgttcgggacttcgctcaccttccaggccccttaaggcctttgtccgttgtcgtcaggactaggtaggtctcgcccaatggcgacagagtggtcacccgggaaccggatctgcgcggctccgtggcctaaagaggcggccgagcctgcttgcgtccctaggccgccttcccgggccgtccacgccttaatggcctccgccgcgcggcgttcgagctgccgccatacttcccggcccaccacgcccagcgccgcccaaaggcgctgcgtcccggcggctctgcgggggtttcgtcgaggcttgggtcgggagacccgggtgccggcggggtccgggctgggagacgccacggccgccattagtcaccgaggtggggtgggaaagagaggttcgctgcggcttcaaggtctgggcacagccagtgggcgggcacagccagtgggcagccacagcagaggcctccgttatctgcagggcagagggctcggcctgtcccggggccccccagttcacccgccggcccggggccggagggcctggagggccctggaggagcgggctgcgttctgcgtctctccgcgatctctgccggaccggaactgacttggcagttctctgcgctggcaagagaggagcggtaccggaagtgcccttgcgctgggggcccgcgagccgtggttccgggtctgcaatgttccggcgtgggggtggggaatggggaatggggtgtggtcacgtggggttagggccccctccaccccgcttgctcttcgcaacggaaattgctactggcctcagaattccctgagcaaacgttgcttctctatctccttactcctccggtgctggataagaagactccaatatttcatttattgactcatttaccacctgtttaccgagcacctatgtgcctctaagcacgggggagtgcagcagtaaagaaaaaaacacaggaaaatttctgctctcctaaaatttacattctagtaagggaaacaacaataaacaagatccttaaaatgcataaaagggtagatagcgaaagtgctttggaaacataaaaaggaaagaggaatatgaagtgcaggtgcggaatgctttatagtacggccaggtgactctggagcagagacccgaaggaggcgaggggatgagccatgcttggagatgtctgtaggggaacagcttatgcacaggccacaaagccgaagcatgtgggccaggcctgttccaggaacagcaaagaggctggggaagagaggagagaaatgggaccatgggagggagttgaactgcagtgcgggagagctgaagtggaggcaggggcagaagcagggagacctgataactgactgttgcaatcaagcaggtgagctatgatagggacttatgccagggcgacgacagcaaagggggcaaaaagtggttgaattcaggggttgacataagctcaagtctataagatttgctgacggaccagatgtgaagtgggagagcgagaactgaaagatgactccacactttttggcctgagcaaatgaaaaggcagccgccttaagtgagatggaagaaaccatgggaggagcaagctttggggagaacaccaggagctgagttttaggcatgttaagtttgagatgtctgtttgacattcaagtggaaatgtcaagcagacagatggatttatgagtctggcattcagggaaaggtttgaactggagatgaatctttgggagtcgtcagcatatagatgtctttaaaaccttgaggctgcatgagagaaccaagagagggacaaggtctgaggtctgatccctgggtaacgtttacaggtcagggaatgagaaggaaccagcaaaggagactgagaagcgaccagggtggtaggagaacaaccaggagagtgtggtgtcctggaagtaaatgaggaaagtgtttcaaggggaatttatcaacagtgtcaaatgctgctgatgtgtcaattaagataaggttggaaatgacacttccagcttttagaattaatgctgtgatgaacttcctcgtgaattttcacattttgtgtagacttctgaattcctttgggtttttttgttttttgttttagatggagtcttgcgctgtcacctagtctagagtgcagtggcgcgatcttggctcactacaacctccacctcccaggttgaagtgattctcctacctcagcctcacgagtagctgggattataggcgcccgccaccgcgcccagctaatttttgtatttttgagtagagacgggggtttcaccatgttggccaggctggtctcgaacttctgacctcgtgatccacctgccttggcctcccaaagtgctgggattacaggcgtgagccaccgcccccagcctctgagttcctttgtttgtatttgtatttttattttttttttttgaggcagagtcttgctctgttgcccaggctgtagtgaaatggtgcgatcttgactcactgcaacctccacctcctgggttcaagtgattctcctgcctcagcctcccaagtagctgggattacaggcactcgccaccaggccaggctaattttttgtatttttagtagagacggggttttaccctgttggtcaggctggtctcgaacttgtgacctcaggtgatccacccaccttcgcctcccaaagtgctgggattacaggtgtgagccaccgcacctggcctgcatttttattatttttaaaattatttatttatttatttatgtttgagacagggtctcgctctgtcatccaggctggagtgcagtggtgccatctcggcccactgcaacctccaactcctgagttcaaatgattctcctgcttcagcctcccaagtagctgggactacaaacgtgtgccaccatgcccagctaatttttgtatttttagtatagatgagatttcactgtgttggccaggctggtttcaaactcctgacctcaggtgatccacctgcctcggcttcccaaagtgctgggagtacaagcatgagctaccaccactggccctgagttcctttggatacaattctggaaatgtaaagaaagatcaaaggattaagactcttgatgcagactcagacatgattcccaggaggaaaatcctgcagtcagaaaggccttgctggtggaaggtggacaggagaggtggcgagaagtccaggggctctagtccacaatgagatgacaaggccctgagccaggagagttgcacagaagtagaaaaccggtgaagtgagtgtttctagcatttcaagagaagaagccagtgggctgaatacctgagagaagagggaggaggggaaggaagagccatggattatacaagtttcaaacactagcgctaatgggtagtttggtagttgatacattagccaagacaaggagtaggagaggctcctggtcccctttctgagcttcccaccgcctaagcagccaaacatgtgggtattcctggaacctaaagatgaggatgatgaaaaacatgtatacatcctgctttctttttctttttcttttattattttttttccgagacgcagtcttgctgtgtctgggctggagtgaagtggtgtgatctcggctccctgcaaccctcgcctcccaggttcaagcgattctcctgactcagcctcctgagtaactgggattacaggcacgtgccaccacatccctttaatttttgtattcttagtagggatgggatttcaccatgttggccaggctggtctggaactcttgacctcatgatccgcccacctcggcctcccaaagtgctgagattacaggcatgagccactgtgctcagcatacattctgctttctacctgatagctctacttgaatgttccaacagtatctgaaactcctcttgtgcaaaacaaaactcttggtatctccccagagcctgctcttccctatcagtaaatggcagtatcatccacctgtttcccaagtaatatggtttggctgtgtctccatccaaatctcatcttgaattgtactcctataattcccacacgttatgggagggacccagtgggagataatttgagtcatggggtggttccctcatactgttctcatggtagtgaataagtctcatgagatctgatggttttatcaggggtttccgcttttgcatctttctcattttctcttgctgctgctgtgtaagaagtgcctttcacctcctgccatgattctgagacctccccagccatgtggaaatgtaagtccgattaaacctctttttcttcccagactcgggtatgtctttatcagcagcgtgaaaatggactaatacaccaagtaattctcgatctcccttgattccccattctctcacttcccacacggcaaccatccccagtcctatctgcctcctaaatatatttcaaatacagccaattccctgtgctgtccattatagtagccactagctacgtgtgcctatttaaattgtaattcattagaatgacatgaaattaaaaattcagttcttcagccacaccaccctcattccaagtgctcaagagtcacagggaactaggagccagtggctaccatatgagcacaggtggagaatgttcccaccatcccaggaagtcccattgacagtgctgatctgtatccaaatccaagctagcaacgtctttcatttggatgactctaatagccccttaattgttgttgttctggtttctactgctctccctttctaatccgttctccctacagaagccagaatgaacttttaatcaaaaatcagatcttataactctcctgtttaagccttcagtggcttttcatcacacttagaacaaaatcaaacttatttccacgaccactgccttccatgacctgccctttgacctgccctttgtgtccctcgtgcctcatctttgtttttttttttgtttttgtttgagaaggatctcaatctgtcacccaggctgcagtgcagtgcagtgcagtggtgtgattatggctcactacagcctcgtcctccctgggctcaggtgatcctcctgcctcagactcccaagtagctaggactatagacacacgccaccatgcccagctaatttttatatttcttgtagagagagggttttgccatgttgcccaggctggtcttgaactgagctcaagccatccaccctccccagcccgtcccggcctcccaaagtgctgggactttaggcattagccactgcccccagcttcatgccccatcttgagccactctctccctgtctcgttatatgccagccacgctagtctccttgctgttccttccactctctgagctcttctctgcctcagggcctttccacatgctgtctacctggaagactcttcacctcttcactgggtttggcaaggctaagtttcttctcatcctataggtctcagctccaatgttatctctttagacagcctttcctggccgccctttctccaggcggtctcttccagttatcatcacattgccctacttatttccttccttcatttttcaaaaatctcattattttattaatagtaatgaacatttctgcacatttcttatatgcaaggcactgtactgaggacttggctttatatgcctcactatatttatttatttattttgagatggagtcccactctgtcacctaggctggagtgcagtggtgtaatctcagctcactgcaagctccgcctcctgggttcaagcgattctcctgcctcagcctccctagtgtctgggattacaggcatgcaccaccacgcctggctaatttttgtatttttagtagagatgaggttatgccatgttggccaggctggtcttgaactcctgacctcaagtgatcctcctgccttggccccccaaagtgctgggattacaggtgtgagctgccacagctggcctgctttgtctatttttaatttaattaatttaattttgagacagggtttcaccctctcacccaggctggagtgcagtgatacgatcgtaactctccacagcctcgaattcctgagctcaagagatcctccttctccagcctctggagtacctgggactacaggagtgcatctccacaccctggctaattaaaaaaaaaaaaaaagtttttttttgttgttgagacagagtttcactttgttgcccaggctggtcttgaacacctggctctaagcaatcctcccacctcagcctcccaaagtgctgggattacaagcatgagccaccatgccctgcctatctattaatttactagtttattttctgttctggttttcacctatgtccctggcactcagcacagtgcctggtatgcagtaggcattaataattgtaaagaaattaattaattgagcacatactgtgggccaagcactgtgctcagcactgtacatatattgtctcatttaacctgcacagcaatcctgtgaagtaagtgctactactctcctccttttacagaggagaagctatgtcacttgtctagttctcagaaaaaaactaggattttaatccaactcatctgactcccaagctccctgggaaggcactataggggatttagaagtctgagtacacacagcctgaaaccacccacagctcagactagcagcagggaaactaaagtattcctttcttgaagggctttctatttcagatcaggccacagattctggtgtgtcactgctcaatcaggaggcagattcaggacctgggtcagggcttaggcttggacagagtcaagaaagctaaatggctgggtgccgtggctcatgcctgtaatcccagcactttgggaggcggaggagggcagattgcttgaggccaggagtttgagaccagccagaccaacatggcaaaacctcgtctctactaaaaatacaaaaatgaagctgggcacagtggtacacgcctgtaatcagcactttgggaggccaaggcaggcagatcacctaaggtcaacagttcgagaccagcctggtcaacacagtgaaaccccatctctactaaaaatacaaaaattagcctggaatggtggctggcgcttgtaatcctagctactcgggaggctgaggcaggagaattgcttgagcctgggaagcggaggttgtagtgagccaagatcacgccactgcattccagcctgggcactgagcgagactctgtttcaaaaaaaaaaaaaaaaacacccaaaacaaaaacaaaaatgagccagtgtgatggtgtacgcctgtaatcccagctacttggaaggctgaggcaggagaatcacttgaacctgggaggcggaggctgcggtgagctgcaatcgcatcactgcactccagcctgggcaatagagggagattctgtctcaataataataataataataatggctgggcatggtggctcatgcctgtaatcccagcattttgggaggctgaggcgggtggatcacctgaggtcaggagtttgagacttgggaaacaaaggcagtgcaacatctgtaccttcccgggcctgggcatacagtcccaccattattgctattagcatttgtctgcactgaggcagatctaattgtcatcagggctctggaaaacaggtggtgttgggggggtgtcccataaagtccacttaggatcatcattatttttttattttttattttttttgagatggagtcttgctctgttgcccaggctggagttcagtggctcgatctcagctcacagcaagctccgcctcccgggttcatgccattctcctgcctcagcctcctgagtagctgggactgcaggtgcctgccaccacacccggctaattttttgtatttttagtagagacggggtttcaccgtgttagccaggatggtctcaatctcctgacctcatgatccgcccgcctcggcctcccaaagtgctgggattacaggcatgagccaccgcgcccagccaggatcatcattattatcattgcttgaacgtgggatttggttttgccctactacagtttctcaaacttgaatcgtttctaaatcagcctaacaactttttccatatccatgtaccacaatgtgtcagtccattcaggcggttagaacaaaataccatcaattgagtggcttataaacaacagtaatttatttcttacagttctggaggctgggaagtctaagatcaaggaaatggcagattctgtgtctggcgaaggcccagtttttttttttttttttttttttttttttttttttttttttgagacggagtcttgctctgccacccaggcaggagtgcagtggcacgatctcagctcattgcaacctctgcctcttgggttcaagcaattctcctgcctcagcctcctgagtagctgggatcacaggtgcctgccaccatgcccagctaatttttgtatttttagtagagacagggtttatttctttctttttctttctttctttttttttttttttttgagatggagtttcgctcttcttgcccagactggagtggaatggcgcgatctgggctcactgcaacctctgcctcccaggttcaagcgattctcctgcctcagcttcccgagtagctgggattacaggctcctgccaccatgcctgctaatttttgcatttttagtagagacggtattccaccatgttggccaggctggtcctgaactcccaacctcaggtgatccgcccaccttggcctcccaaagtgttggaattacaggcgtgagccaccgtgcctggcccggcctcttttataacattgatcccattcatgaaggctcttctcccacgatctaatcacttcctaagggccccacctcttaataccatcactgtgggggttaggatttcaacataggaatttgggggtgaggggtcacaaacattcagaccatagcacatcagtaccagtttctacttaataccgctctatgaattgactaatttcgcccaactgttgctacattaaccttgtcctcagcagtatttgtgaaatcatcaagttgacatgctagttatatgttttcctaatatacattaaagtaaatatataactctttaaaaaatgttcttctgggttgcacttgaaatcatctcggtgcaaccagtggaacccaaaccacacttagcaaagcaattagtgtcaaagggacacaggcaacagccgaaaaagctcccaaccaggcgcagtggcttgcacctgtaatcccagcactttgggaggctgaggcaggtggatctcctaaggtcaacagtttgagaccagcctggccaacatggtgaaaccccatctctactaaaaatacaaaaattagccaggcatggtggagcacgcctgtagtcccaactactcgggaggctgaggcaggaaaatcgcttgaaccccggaggcggaggttgcagtgagctgagatcgcgccactgcactccagcctaggtgacagagaagactccatctaaaaaaaaaaaaaaaaaaagctcccaatggccaaagctggaacaatttgagcaacaaaataacatagtattgggataaagttcaaagtataaaccaaatatccatgagtccatactgttataaatgattaaataaataaatgagggagggctgggcgcggtggctcacgcctgtaatcccagcactttgggaggctgaggcaggcagatcacctgaggtcgggagttcaagaccagcctgaccaacatggagaaaccccgtctctactaaaaatacaaaattagccaggcgtggtggcgcatgcctgtagtcccagctacttgggaaggctgaggcaggagaatctcttaaacctgggaggcggaggttgtggtgacccagtgttgtgccattgtactccagcctgggcaacaaagtgaaactctgtctcaataaataaataaataaataaataaataaataaataaataagggagaagagacaaatgatccttaaagaagaattctagataatgtaggtagatacaaccccttcaggttgtggagcttaattctcccattgagtgtgggctgcacttagtaacttgcttccaaagagtggaaagggaggaaaaacaagcaacttcccaggggagaaactggacagacactcgcttggccaggtaatcaagtcatgtcgctaacatgtatcctgatgaagtcatgtcaataacatgtacctatgatttgatgagaagagcagtttacctctatgacatgtttccccaaactcataaccccagtctaactatgagaaaagcatcagatgaacccaaattgaggggcactctgtaaaatacctgtccagtactcctcaaagctgtcaaggtcttaaaaaccaagaaatgcctgagtaattgttacaagccagaagaaactaaagggacatgatgactaaatgtagtgtggtgtcctagaagggactctggagcagaaaacaggtggaatttagttcataggaatgtaccagtgttggtttcttagttgtgacaaatgccatagtaatgtaaggtggtaataataggggaagcagggtgagggctatacaggaactctctgtactcttgagtatgatggttaagttcatgtgtcaacatggagggtggttttggatgatattagcatttaaatggttgaacttgggtgtgggcgggcctcatttgatcagttgaaggcctgaataaaacagaaagactggcctccctaagcaagatggaattctccggcaggctgccttcaaactgcaccattggctctcctgggtcatcagcctgcaggcccacactgtgggattcgggcttgccagccttcataattaggtaagccaattctttatgataaatctcttttatgcacacacacaccgtattggttctctttctctggtgagccctaacacaatgggaaatttctgtactctaaatcaaagacttacatttattttctgtaaatgtaaaattattttaaaataataagtttattttaaaaagagagaaggctgggtgcggtggctcatgcctataatcccagtactttgggaggccgaggtgggtggatcacctgaggttgggagtttgagaccagcctggctaacatggtgaaaccccatctgtactaaaaatacaaaaattagccaggcgtggtggcgcatgcctgtaatcccagctacttggaaggctgaggcatgagaattacttgaatccatgaggcagaggttgcagtgagccgagatcacgccactgcactccagcctgtgcaacagagcgagactctgtctcaaaataaataaataaataataaaaagagaaaaaaagaggcatgaattttgaagtcatgtagatccatttatttgtttcctgtgggtgccaaaacaaattactacaagcctggtagcttaaaacaacagaaatttattctctcatagttctggaggccataaattgaacatgagtttcactgagctgaagtcaatgtgttggcaaggctgtattccctccagatgctctggggaagaatccgtctgcctcttccaacttctggtggctgccaacaatccttggcttgtggccacatcagtctctgcctccatggtcacattgcttcctcttcttctgtgtgtgttggtctaatcttcctttccctctctcttataaggatatgtgtgatggaatttagggcccacttggctaatcctcaatgatatcctcatctcaacattcttaatcacatctgcaaaaattattttctcaaataaagtaatgtttacagtagtttccagagattaggacttgatatatttgggtggccattattcagcctactacaccctggctgtgtgaaatgtaggacttttgtagtatgagtaagccggctctatacttaaaaataaaaactatgacataacctggttttaaaaaatgttcatctgggttccacctgaaatcatcgtattatgaccactagtgaggtaggaggcaggactcgagtctggaggtggggttcagacactggaccaaattgaggactagctaaagcagggatggggtagaagaagctttccataagacatgcccaccagtgtgccatgccagtttaccattgccatggcaacactcagaggttactgccctttccatggtagtgacccaagaccaagaagttaccacctttttcctagaaatttctgcataatctgcccctgaatttgcatgtaaataaaagtgggtataaatatgactgcagaactgcgtttgagctgctactctaggcacactgcctatggggtaaccctgctccacaagaagcagtacgtctgctgctgccgaacactgccacttcaataaaagttactatctgacatcactgacttacccttgaattctttcaagtcaagaaccctcctgggctaagccccaattgggatcacctgccctgccttggtgggacccaagccacactttgccaaacagtgtaagagattggtcttagaggtcagagagttctacattctaactctggcaagcctgtgactttggttaagtcaacatattccttgaagactatctcttcatctgtacaagaggacactagccctgactcagaggaatgctgtcagaactcctgcagactgtgaaacagatgcacaacaaatgatcagtcacattctcctccccctccattttatagtttgttacacttcacaaaatattttctacatacaataatgtttgatccccataaaatgtgtgagataaagccaaacgtttccttctcagatggagaaactgagacttgatgtcaactgacttagccaactttgcctaactagaagactagaagcagtgggtgtctgagagcatagtcagcagaagcaaagaggcagatgccccccggagatggggcaggtttgctgatctggcatttgatttttttttttttttttttgagagggagcttcactctgttgcccaggctggagtgcagtggcgcaattgcgactcactgcaacctctgcctctcaggctcaaggtgattctcctgccttggcctcctgagtagctgggattacaggcacccaccactacacccggctagtttttgtattttcagtagagacaggctttcaccatgttggccagactgctcttgaactcttgacttcaaatgatccacccacctcggcctcccaaagtgctgggattacaggcatgagccactgtgcccggcctgatttttttttccatgattttcattacctttctgtccccggtaggcatttgagtttatgatccatgatatgttcctaactctggttcacactgctataacttgatcatagacttttggacttgaagctgtaatactcctggggttccccagtgacagcccacccagttttccagtggcttcttggccctggcttctctgatctcacaggcttccccttcttctaaatattgcaaggcaaacccatagtttgtcctctggtttgaccaggttcttggttctgatagccccttattctgagccttccaggcagagactcctacaggactctgccacctcaggacccagcatagggctgggtgtcctgaaggtctgctaaggggactcatgctgagccttcggaaggtcacaaggagagaacagagggtgggctgagggtccacatgccaacatgtcaggagttggactgcttgggttccaatccggctcccgcacctcactgcccctgaccctgggcaaatcaccaaaccctttgtgattggtttcctcatctgtaaaaagggaatcattatagaaccccaaagcaaaattataaggctcgggtgaaatactgtatataaaccttttattacagggctgggcacaaggtgagtgctcgccttgacattgttgcgccagatttccctaagcacatcactgcatggctgttctctcttctggatacggccgccctttctgcctagagacgtttgattcttcctggggggcggtgcagggtcaggtgagcagctggggctccggagggtctgggtctctgtcacttcttgctgcgtcgccttctgtgagtccttcccagccccctaatcatgcccgcctgagcaagaggatgagaaaatgccgaccccgtagcggggactctgctgctgtgcggggcgcggttcgccgaacccactggccgcttctagagagtcggccccagggccaggacctccacttggcaggcgctggggcgcccaggggcagggccagcgcgggaaaggccgcgagtccttcgaccccctggcagtctgggagccggccgcggctgccatggcaacgcccggaagctgccgggaggggaggcaggcccagccgggacgaggccctgcctccagccaacgctccgcccagaacgaagccccgccccggaacgaagccccgcctccagcaactctctgcccggagagaggcccgacagctgcgacccgactggttctgtccgagcccgacgggccgcgctgacccagcgactgtgcctgactgaccacaggtgccgccaccgcctgataatacgagtgtgtcagcttccgtctgactgaacgcaggtttcatgggtgcctgacagaccaagactgctggatctgtcagcctggccgcagctggctgactggctgactggctggctggttgactggctggctgactggctgcctggctggctggctggctggctgctcttgcccggccgccatctgggcctgacgggctgcgtctgaccgggcggcctatctgcctctgcctgaccagcctccatctgtgcttggcgagctgtgtgaccggccgcgacggtctgtgtctgactgagcacaaggttcctagcggccgatcagctgcttgaccccatctctgctgagccggccgacaccgacggattgactctggcaacgcctggcccgagtggcgctaccggcttccagagacttcctgacccctgccgaggttgcaccgctcagcgctgccctgtgaggcgctgactgtggccgcagctgagtgcggctgccccttcacagacagggcgtgcagaatgacggtcgcctggctgtccctccctaggcgcccctggctagctcggcttgcctggcagcgtctgtgtctgagggacgtgttggtggccgccgctggccgcatctgtccccctgcaggtgggcatcaggttgcccccgtgaagtgcagctggggccgagcctggctgaaggacggccaccttctctccagctgtccagcgagggcttctgaggtggtgccctccggggctctgtggcctggacctctccagccacacacagtcagagccttaggggatcccaagcaagggcacccacagggaagagagcctaagacagaggccaagggacaggcaggcagcaggggtgggacttcgggccaggcgaggaacagctggaagaagctccggggctgggaggaggccgcaggaccttgaggtgccggagtttagggatccgattctgtaagggaggcagcaccttgaggagttgggttggtgtgtggggtcctcaggacacgatccctgactttgaatacctttttttgcgggttttggggaaatctctgtcagtgccttgctgctctgcagaagggtcatcccgcagacctcagatctcttcccgaattaattaatttatttatttttatttatttttttctttttttgagatggagtcttgctctgtcgtccagcctggagtgcagtggcccgatcttggctcactacaaactccgccttccaggttcaagcgattctcatgcctcagtttcccaggtagctgggattacaggtgtgcgccaccatgcctggctaatttctgtattttagccgggggtttgtagagacagggttttgccatattgcccaggctggtctcaaactcctggcctcaagtgatctgcccaccttggcctcccaaagtgctggggttacaggtatgagccactgcacccagcctcttcctgaatttaaatctctcccagcctgtgtgtgtgtgtgtgtgtgtgtgtgtgtgtgtgtgccagccacaccaaccacatgcaatggcttcccccctggaaggagttgttctgtaccagaataagggggaaggaaatactggtcagagggatttatttttttaaagcaagcatgggtatgctatgagttattgctattaataataatacaatgaaagcatcagactagtttatttcgaactagctctagcatgctaagatgttgcctctccattaataacagggccctggctgcctcgttgatttcattataggccatgggaggaatgggaggaaatgaacagcttcactcccaagggctttcataacatggatttggatctcagccagtgtgggcagtggggcttcccgggggcaggggactcctggggtgctgggaaaaagaggcagcaacaagttgcatggagcatttgtacctcatttatttattcatttattcaacaaatatttattgagtaccatgtgccaggcactgtgccagactctcactctgtcctcatggaggatagccttatgggatccaggaaacctctccagtgcctcccaactctggtcctgtcaaagccacatgctgggtaccaactgctttctttctgagctagctgcacagctaaaatgggagagctagtagagtacagtggtcctgaaattgtggtccttggacgagcagtatctggaccacctgggaacttattaaaatacaaattctcaggtcaggagatcgagaccatcctggctaacacagtgaaaccctgtctgtattaaaaatacaaaaaaattagccaggcgtagtggcgggcgcctgtagtcccagatacttgggagactcagacaggagaatggcgtgaacctgggaggcggagcttgcagtgaaccgagattgcgccactgcactccagcctggatgacagagcgagactccatctcaaaaaaaaaaaaaaaaattatcgggccctatctcagatggactgaatcagaaactattttagtgtagggcacagtgatctatgttttaacaagcctccaggtcttgctgatgtcctgagaaccaggacaaagtcgtgctaaagtctgagaaccactggtggaataattaattgtgttggctctagtatcacactgtccatatcagaatctcaatgctactacataagagctgtgtgactttgaccaagttattgaatctttctgtgccttaattttctcatttgcataattggtataattatgattaccctaaaccattgttgtacatattacatcacgtgaaaaggttagcgcacaatttcagctctaggaacatatcctgtggacatatttcttttctttctttcttttcttttctttttttttttttgagacagtttcgcttttttcacccaggctggagtgcaatggcacaggcttggctcactgcaacctctgcctcccgggctcaagcaattctcctgcttcagcttcccaagtagctgggattacaggcaccctccaccacgcccggctaattttgtatttttagtagagatgggggtttcaccatgttggccaggctggtctcgaactcctgacctcaggtgatccacctgcctcagcctcccaaagtgctgggattacaggcatgagccactgtgcccggccctgtggacatatttctgcatatgctgaaagacaagtgtaagggatattcattaatttgttgtttataaacacactatttatttatttatttatttttgagatggagtctcgctctgttgcccaggatggagtgcagtggcacgatcttggctcactgtaacctctgcctcccgggttcaagcaattctgcctcagcctcccaagtagctgggattacaggcgtgcaccacggcacacagcgaaattttgtatttttagcagagatggagttttgccatgttggccaggctgatttcaaactcctgacctcagatgatccacctgccttggcctctcaaagtgttgggattacaggcatgagccactgcgcccagccaatgcattcatttctgtaaaaaaaaaaaaaaaaaaaaaaaaaaaaatctttataaaatctttttttttttttgagacagagtttcactcttgttccccaggctggagtgcaatggcgcgaactcggctcaccacaacttctgccccctgggttcaagtgattctcctgcctcaacctcccaagcagctgggattacagtcatgcaccaccacgcccggctcattttgtatttttttaatagagacggggtttctccatgtcggtcaggctagtcccgaactctcaacctcaggtaatccgcccgccttggcctcccagagtgctgggattacaggagtgagccaccgtgcccagcctataaaatctttatacagatacaggctcatgtacatctgaaaggatactcaaggaactggtaacagtgggagaagaaatgggtggctggaaacaggagaagggaaacatttttaccatacatacacccttttatgacttttagattttgcagtatgtgcatgcattttctattcacaaaaatgaaattttttaaaaaagggggcagtacttagcacaatgcctagcagtggtggcggtggtggtgatagcctttctgcagctctgggcagatgattcactgcagaaatgcagcccagagatatctagaggctggccatagcctccagactgtcctcctagcctctcggtctcccttcttcattctatatgatccatgtttccccatcggagaatctttgcattttagagatgtaaaggggcttcagattttctagtgcaactgttttaacggtgaagaaactaagcccccaaaagatgccataaccagtccaaggttatcaacagggttcaatctagggcctcttttacaccatcctaagttttctaaaattctgctgtcattccatcactgctctgcccgtgaatcctcaacctggctattaagactagctgtggtctaggccaagcacagtggcttatgcctgtaaccccaacactctgaggccgaggtgggcagatcacttgaggtcaggagtttgagaccagcctgactaacatagtaaaaccctgtctctactcaaaatacaaaaattagctgcgtgtggtagtgcacatctataatcccagctactcgggaggctggggcacaaaaattgcttgaacctgggaggcagaggttgcagtgagctcagagtctcgctctgtctcaaaaaaaaaacccacaaaaaactagctgtggtttaactcccaaccaaatttccagccttatttgccacccttttcttctatgtgaatcctctaccttagccagatagttctctttattgactccaaatgctcctgctttccaaatgccatactctctgcctgaaatgcctttctctttcctgtccatttattgtggagattctacctaaacatggaagctaagcttaaatcatacttccttcaggaagtcttccctgattacttcagctcacagagctgtctccctctgaactagttaaaaaagttcttgtggctgggcgcagtggcttacacctgtaatcccagcactttgggatgtcaaggcaggcggatcacttgaggtcagaagtttgacaccatcctggccaacatggcaaaatgccatctctactttaaaaaatacaaaaattagctgggtgtggtggtggtgcatgcctgtagtcccagctactcgggaggctgaggtaggagaattgcttgaacctgggaggcagaggttgcagtgagctgagatagtgccactgcactccagcctgggtgacagagtgagactccatctcaaaaaaaaaaaaaagttattgtaaaaaactcctgctccttaagagggacgtaggatgtttgtctgcttcttgggtaatgggaaattaacttggatagagctcattcctcattctctatttctgcagctataaaattgggccaataaccttagccctccttattgtctcaggaaagccctgggtgaggatgccactgagcccgcctggagccaggagctggtctgcagaaactgctgggcctgtttctactctgatgtttacttggcctggaggcccagtgtgatgaaacccggccctgttgccgagcaccttgggaagcctccctccagggtccctctgtgctcagacagtggccctttgtagagtggaggagcagactgaaagcggagctgctggaaaccgtttcctcccctctgcctcgagcaacctcctcccgcagccacagaccatcctgtgcctgggtggcctctgctttaagtctgcagctggcggggtaagatagggtctctaggcagcctgctaggctggaagggtgaggaggggtcctggcaggatggccagctgaaacacagcatcccctaactcaatacagatcacttataacagggctttccaaagaggagactggccccttacaggcaagattgacatttcaccatcccctgccaccactcaataagcgcctaagatttaggctagaagtgatgtggtttgtcccttctgtccctacttcactggcccctatactcactagcgggggggattgggaatccttagacataatcccaaacctggtggagtaggagttcagtaagtggggaagaactaggaacaagaggaaagaaggtttaagagtgtggtataggctgggcacggtggctcatgcttgtaatcccagcactttgggaggctgaggcaagcggatcacttgaggtcaggggtttgagaccagcctggccaacatggtgaaaccccatctctactaaaaatacaaaaattagccaggcatggtggcgggcgcctgtaatcccagctcctcaggaggctgaggcaggagaatcgcttgaacccggaaggcagaggttgcagtgagccaagatggcgccatttcactccagcctgggcgacaagagtgagactccgtctcaaaaaaagtgttgtataggtgaaaggacacttaactggtctggggggcaggaagcctgggattccatttctgctgagctactgacttgctgggtgacattagctagttgtttcccttttctatgcttcagtttcccagctgcgaaactgtggaggtggagtaaataaatgttaaggatttttgcagttctaatttttcccaattctttgatcagaaggaggaaaggaaagctgggggtgggttggaggtaaataactggcaggatgccttccatggattcacctgcagtctccaggcagcttcttctctgccactaagatctcttccccttccgtttctccccctcttctttccaccccactctgagggcttcttgtgatgagatctaaaagctgtcttacttacaattgcttatactgtcttttgcccacaaagggaggagactgtgcacaatcatggagggcagtggcaagtctggtggagagggaaggaggtcaggaaataaacgagagaggaaaattaagaggtaaggatgtgatagagggaagtattgaaagaaagctcagggagagtgaaaaggaaggaaaaggggagagagaggaggtaaaagtgaaggaaagaggttgagtgcagtggttattcctgtaatcccagtactttgggaggctgaggcaggtggatgacttgaggccaggagttcaagaccagccagggcaacatgacaaaaccccatctctacaaaaatacaaaaattagcgggacatggtggtgtatgcctgtagtcccagctactagggaggctgaggtgggaggatcacttgagcccaggaggtcgaggctgcagtgagccatgatggcaccattgcactctagcctgggtgacaaagtgagatcctgtctcaaaaaaaaaaaaaaaaagaaagaaaaagagtggaatgaaatggagaataaggaaggtacaaatgggagagaaaaacaggaaaagaaaccatgggagaaaaccagagcctgggcaaacgaacatgcaagtggagacatagtgttttctaggacaacaaaacactttagtttggctagagctaagagtgtggtaggtagacaaaattagaatcagattgtagaaggtcttggatgccaggttaatgattttgaactttatattttttattttcctttgttcaaatcccctgtgataagttgttttattttgtttagagtgggtatcaggcagatttctgggtgaggcccagaggagcatttttattcatccatccattcaacaagggactatgtcttatccaacttgtatccctagagtataacacaacatctgcatataagacagaaagtaagtgcttgttaaaattaagcattttggccgggtgtgatggcacacatgtgtaatcccagcactttgggaggccgaggtgggtggatcacctgaggtcaggagttcaagaccagcctggccaacatggcgaaaccatgtctccactaaaaatacaaaaattagctgggcatggtggcatgctctggtaatcctagctactagagaggctgaggcaggagacttgctagaatccaggaggcggagatgcagtgagccaacattgcgccactgtactccagcctggacaagagagtgagactaggtctcaaagaaaaaaaaaaaattgagcatttggagaaagcagtagttgagacagtctcacagagaatataagaataatcatattaaaaggtaaaaagtgctaggtgcccagagagaggcccagaaaagggagatcagaggagaatgagacagccttccctgctacctttagcagaaaagtcccaaagaatattataatggggccatcttggctacttgaattaatccttgtggcctgaaagatacattctgttggagggtatagggttctgtctatcttctgagtgaagggcaaagagttctccgaagaaaagggagggattattactggaagaagggaaattagaactggcatgtctgccaggtctgctgtagtggaacaaggtgaggcacatatagggaacagtgagaaggattaggagctcttcaagagtggtaacagttaaaaatagagctacaggccaggtgcagtggctcacgcctataatcccagcactttgggaggctgaggtgggagaattgcttgagcccaggagtttaagaccaacctgggcaacacagtgaaaacccgtctctacacaaaataaaaaattagccaggcgtggctgggcgtggtgactcactcctgtaatcccagcactttgggaggccaaggtgggtggatcacctgaagtcgggagtttgagaccagcctgattaacatggtgaaaccctgtctctactgaaaacaaaaaattagccagacgtggtggcatatgcctgtaatcccagctacttgggaggctgaggcaggagaattgcttgaacctgggaggcagaggttgcagtgagcgagactgcaccattgcactctagcctgggcaacaagggcgaaactctgtctccaaaataaataaataaataaaaagaaagagagagagagaggtgcaccatggagggcctcaaataccaagttgtggagtttgaacttgtctcttgaactgagagtgcgcttgttgaagttgtgctttgggagtactaatcaggccaccaaggtatggaatggactggaggcgagaagaccaggactgatgggaaattgttctggcatgtcctctggtaaagcctaagcatgagatccttcacccacatcaatgtgttttccgttgtaacttggtttggtttttttgttgttgttcttcttcccattctaggtcagtggattcaaaacgatgaaagtggattcaaaacctctgtcaaggggtgctgtcctttcctggccaagtctcttttattctcttagggctgcaacctcttcacctgggaaatgaatggtcctgtgatttacaagagcaggtaagcacctgcaaagggctttgaagattgatgggcagagtttccagctcaatttctggggagtggcagtatcagcagcaccccgtccctggctctgacataacgatgggagaagcagctccaaggcatcctgctttttttttttttttgagacagagtctcgttctgttgcccaggctggagtgcagtggcacgatctcagctcactgcaacctccgcctcccgggttcaagcaattctcctgcctcagcctcctgagtagctgggattacaggtgtgtgccaccatacctggctaatttttgtatgtttagtagagatggggtttcactatgttggtcaggctgatctcgaactcctgacctcgtgatcctccctcctcagcctcccaaagtgatgggattacaggtgtgagcccctgcgcccagctggcatcctgcttttgagcaggaggtggcccaggccgtagcccagagtcaactctctcctcttcccaaatatctccacaaaggaaaactctgtagcatagcctaagagggagcataagactttgaagtcagacatcccaggccttggtcctcagttgtgcttcttcctagctctggtattttgaataagttatgtaagttacctgagcctatttccttgtatataaaatgggggttgcaatactaatttcctgggctcgtgagagtagagtaagctaaagctaaaaaagcacttggcacagtgccatacaagccacaggcactcggccagtgtgaattcctattcattttttaagaaacagagtcatgtactgttagaggtagagaggtgttagatattcctggtccaatcctctcattctacagtggtaaaaggactcccaggaaggtttcctcttaaccaatctaattctcttctgtcacaatatctgctgattctgtcctcaactagaagcagagaactgagctccaccttctatgcttagctacataaatccgatgggagttctatacctgttcaaaaaagggtattttggttcctccatttttccccccaagaacatttgcctatcatttgctctttgctctgctaaaggtgaagacaattagtgtcccatactcaaagtgatcacgaatatgtgggaagatcatgagcaacacagtatagatgaatcctaagtaaatccagcaatcttggaatatctgaaggaatttgctcccaattattcttagataagctaagaaatgaatacaactgttagttatcgtgtttgtgtttttgtttttactctgcttaattttttaacatttttatttatttctataattatagaaatggggggggggggtctcactatgctgcccaggcaggtctctaactcctgggatcaaatgatcctcttgccttgacctcccaaagtgctgggattacaggtgtgagccactgtgcccagcttctgcttaatttttatttcccagttggcaggggctccctaattctttagctttacttttttatggataaaatatacatagcataaaatttatcattttaactattttttgacagataaacagtttctttattcctcctcatcctcctcctcttcttcatcttcctcttccaccttttcctgggcaactttagcaggaccatttgcaccatcaaactttccttttgccttatagtcagaaacatccttctcatacttcttcagctttgccgccttagtgaagtaaggctgcttttcactgtcatttaagctattccacatttcacccaacttttttttttcttttgccacgtctccaatagagatgccagggtttgtggatttgatctcggggcagaattctgaacagaacaggaagaatccagacagtagccttttggggcattaggatccttcttgttgcctcctttagctggtccataatccttcatttcccgatcatagtgtactttatccgcctttgccatttcattgaatttagacttctctttcccagacatggtcttctacctctcggagcacttcctggaatattctgcaaaattgacaaggacctctgggtttttcttcttatgttcttctctgcacatctgcacaaagaaggcataagcagacatctttccctttggtttcttggtgtcacctttagccatcctgactgaatttcttcttccttcccggccgcctagcaggagggaaggcggaggggagtgaagggcgtggggaggagagggagggccctgggaggcgaagcagcaggaggcggcgacgtggcccgaaagttctgcaggcgctgcggtggcggccccattttaactttttttttattttttattttttgagagggagtctcgctctgttacccaggctggagtgcagtagcgcgatctcggctcactgcaagctctgcctcctgggttcacgccattcttctgcctcagcctcccgagtagctgggactacaggcacccgccaccacgcccggctaattttttgtatttttcgtagagacggggtttcactgtgctagccaagatggtctcaatctcctgacctcgtgatccgcctgcctcggcctcccaaagtgctgggattacaggtgtgagctaccacacccggcaaacttaaaaaaaattttttttttgagacagagcctccctctgtcgccaggctggagtgcagtggtgcgatctcggctcaccacaacctccgcctcccggtttcaagcgattctcctgcctcagcctcccgagtagctgggattacaggcacgggccaccacgcccagctaatttttgtatttttagtacagacggggtttcgccatgttggacaggctggtctcgaactcccgatctcaggtaatctgccagccttggcctcccaaagtgctgggattacagacgtaagccaccacacctcacccattttaactatttttaagtatacaattcagtgacattaagttcattcacaaagtagtgtaatcatcaccacttcctatttccagaactttttcatcatcccaaacagacactctgtacccattaaacaacattccccattttccccttccctcagcctctggtaacctctatttattttaatttctgtctctacgaatttacctattctagatacttcatatgagtggaatcatacaacgtttgtatttatttttgtttgtttgtttgagacagagtacagtgttgggatcatagctcactgcagcctcaacctcccaggcacaagtgatcctcccacctcagcctcctgggtagctaggactacaggcacacaccaccacacctggctaatatttaaaaattttttgtagagacggtgaaacaggaaccctcgaagggtgtgcaatgggggtgtggcttgcttcttcagtgccctgctgctcaaacctctaggggagcatacagatgggcaggctgtggggctccgaccccacagcagtgtctaggggtgaatgtttacagctgaagccccaatgggcgtgtgttatagggtgctcttttaggttgccatctataggcggcttgtgttaaccagctcaattaaacccccttccttaccacaaggacagagggatttctgtatcctggggtttcttgccttgttgtacctggaagaactggatcacatgtgggcttggagaatgagtgcaaggttttattgagtagaactagctctcagcagatgggggagttggggagccagaagggaaatggttttcccctggaaatgttctcatcatgttcaccaacatggtgaaaccctgtctctactaaaaatatttttaaaattagctgggcatggtggtgtgcgcctgtaatcccagctactcaggaggctgaggcaggagaatcacttgaaccggggaggcagaggttgcagtgagcagaaatcgagccactgcactccagcctgagtgacaaagcaagactccgtttcaaaaaaaaatgttagtaaggatgtgaagaaagtgaaccttcatatattgctgggggactgtcaaatagtatcgctgctttgaagttcttcaaaaagtaaaacagagttaccacatgacccagcaattccactgctaggcgtatatccaagagaaatgaaaatgtatgttcataggcggggcacagtggctcacgcctgtaatcccagcactttgggaagccaaggtgggcagatcactagaggtcaggagttcgagaccagcctggccaacaagatgaaaccccgtctgtactaaaaatacaaaaattagctgggcgtggtgtcaggcacctgtaagcccagctactcgggaggctgaggcaggagaatcatttgaaccagggagatggaggttgcagtgagcagagatcacgccactgcactttagcctgggcgacagagtgagacactgtctcaaaacaaacaaacaaaaacacaaaaaacaaaacaaaacaaaaatggaggctgggcatggtagctcatgcctgtaatcctagcactttgagaggccgaagtggtcggatcacctgaggtcaggagtttgagaccagcctgaccaacatggagaaaccccatctctactaaaaatataaaattagctgggcatggtggcacatgcatgtaatcccagctactcgggaggctgaggcaggagaatcacttaaacctgggaggcagaggttgcggtgagctgagatctcgccattgcactccagcctgggcaacaagagcaaaactccgtctcaaaaaaaaaaaaaaaaaaaaaaaaaaaagggaggtggggggcactggctgtggtggctcacgcctgtattcccagcattttgagagaccgaggtgggtggatcacctgaggtcaggagtttgagaccagcctggccaacatggtgaaaccccatctctactaaaaatacaaaaaaattagccaggagtgttggtgcatgcctcccagctactcgggaggctgaggcagaagaatcacttgaactcgggaggcagagcttgcagtgagctgagatgtgagccgagattgcaccactgcactccagcctgggtgactgaatgagacttcgtctcaaaaaaaaaagaaagaaaatgtacgttcacacaaaaacttgtacacaatgtttatcgtgttattatttcttatagccagcaggtagaaacaacccagatgtccatccactgacgaatagctaaacaaaatgtggtatatccatacagtggactattattcagccataaaaaggaataacactgattcacactacaacatggatgaaccttgaaaatcttacgctaaatgagggaaaccaatcacaaaataacatatattgtatgatccatttatatgaataaatcaagacagaaagtagattagtggttgccaagggatagtaggaagttgggaatggggaataacggttaatagtgtgactgcccagtgtgctcaccttgcccactgccaagacagagccgatttatcaagacagagaaattgcaatagagaaagagtaattcatgcagagccggctgtgcgggataccagagttttataattactcaaatcagtctccccaagcattcggggagcagaatttttaaggacgacttggtgggttgggggaagccagtgagccaggagtgctgaatggtcagggatgaaatcacagggagtcgaagctgtcttcttgagctgagtcacttcctggatgggggtcacgagatcagatgagccagtttatcaatctgggtggtgccagctgatccatcaagtgcaggtctgcaaaatatctcaagcattgatcttaggagcagtttagagagggtcagaatcttgtagcctccagctgcatgactcctaaaccttaatttctaatcttatggctaatattagtcctacgaaggcaatctagtctccaggcaagaaagaggtctgcttttggaaagggctgttatcgtctttgttttaaactataaactacgtccaggcacggtggctcatgcctgtaatcccagcactttgggaggctgaggcaggtggatcacttgaggtcaggagtttgagaccagcctggccaacatggtgaaatgctgcctctaccaaaaatacaaaaattaaccgggtgtggtggtgggcacctgtaatcccagctattcaggaggctgaggcagaagaatcgcttgaacccaggaggtggaggttgcagtgagccgaggtcatgccattgaaccccagcctgggtgacagagtgagactccgtatcaaaacaaaaacaaaaaaaacctataaaaactataaactaagtttctcccaaagttagttcagtctatgcctaggaatgaacaaggacagcttggaggttagaagcatgtagagtcgattaagttagatctctttcactgtctcagtcataattttgcaaaggcagtttcaataggcatgggatttctttttgggggtgatgaaatgttctggaattagagagtggtgatggtttcacaactttgtggatatactaaaaaccaactaaattgcacactttaaaatgattaattttatatgttaattatatctcaagaaaaagtacagtatatgatagtaggcacccatgtacatactacctaattccagaaaaaaactgttacaaataccattgcaatttcctatgtactgttcttccatcccattcccctccctctctacccagaagtggccactaccgtgaagttggtgtttatcatggcaattgtcttcatttatttgggctgctatcacgaaatactttagactgagtatcttatacgcaacagaaacttatttttcacagttctggaggttgggaaggccaagatcaatggggtgagggcctactttctcacagacttcacgtttttacggtgacctcacatggtggaagggaccagctagctctcttaggtctcttttataagggcagtaatcccattcatgagggtacccaatcatctcctaaaggcctcatcttctaacactgtcacatttgggattacgtttcaatgtatgactcttggggacacacaaacattcagagcatagcagtaatacatgtctttataacttttaacaaatgtatgagtatccctaaacaatatatagcattgctttgtatgtttttaagcttaatatacatcacataagttgcatcctctgcaatattcttttttcctaccaacattatgtttttgagaattatccatattcttttttttttttttttgagacagagtctggctctgtcgcccaggctagagtgcagggtgtgatctcggctcactgcaacctctgcctccagggatcaagtgattctcctgcctcagcctcccgagcagctgcgattacaggtgcccaccaccacacccagctaatttttgtatttttttgtagagacagagtttcaccatgttgttcaggctggtctccaactcccgacctcaagtgatctgcctgccttggcctcccaaagtcctgggattacaggtgtgagccactgtgcccggtgaattatccatattcctaccactcactgctgtgtagtatttcattatatgactacactataatttattttgtatatttacctattggtggacatttagactgtttctaatttttcaatatttcaaacaatgcttcagagaacatctccaacaggtttccttttgtgcatgttcatttccctgggttttatattcaggagtaggattgccgagtcaaaggcctgcacatcttctacttcgttagctattgccacaagtccattactagtcaggtggagcgttttcatatgtttattggccatttgtatttcttcagtggcttaatgttcacatcctttgtccatttacctaatataaatttgttagtaattctttacatattttcgaattctcatcctttgccagccaaaacattgcagagattttctcccatttagtagtttgtctttttccctttatgacatcttttgatgcacagaatttctacatttaatctggctgaccatatcaagttttttcatttttgatttgtatgatgattaattttatgtgtcaatttgactgggtcatggcatgcccagatatttggttaaacattattctgggtgtgtctgtgagggtgtttgtagatgagattaacttttgaatctgtagactgagtaaagcagattgcccttcccaagtgggtgggcctcattcaatccattgaaggcctgaacagaacaaaaaggtggagtaagagaattctttctccctgtctcactgtgctcatgctggtacttttgtcgtctcctgcctttggacttttttttgagacaggttctcgctgtcacacacgttggagtgcagtggtgggataccggctcactgcaacctccgcctcctgggttaaagcaattctcttgcctcagcctcccgagttgctgggattatagactcctgccaccacacccagctaatttttttgtatttttagtagagatgggatttcactatgttggccaggctggtctcgaactcctgacctcaagtgatctgcctgccttggcctctcaaagtgctaggattataggcatgaaccactgcacccggcctgtctttggacttttatctggaccattggctctcttggttctcaggcctttggactcagactagaactaaaccattggctctcctgtgtctccagcttgctgactacaaatcttagggcttagcttctataaccacatgacctaattttttataatactctctctctattctattggttctgtcagaggcgtttgaaccagagcaactccatcttgagtaggtgctaggtaaaataaggctaagacctgctgggctgcattcctagctggttaggcattctaagttacaggatgagataggagggcacaagatacaggtcataaagaccttgctgataaaacaggttgcagtaaagaagccggctaaaacccaggaaaaccaagatagcgacaagagtgacctctggtcgtcctcactgctacactcccaccagcaccatgacagtttacaaatgtcatggcaatgtcaggaagttaccctatatggtctaaaaggggaggcatgagtaaaccacccattgtttagcatataatcaagaaataaccataaaaatgggcaacaagcagccctgggggttgctctgtctaaggagtagctattattttattcctctactttcttaataaacttgctttcactgggcatggtggtttatgcctgtaatcccaacactttgggaggccgaggcgggtgacctgaggtcaggagttcaagaccagcctggccaacatggtgaaaccccgtctctactaaaaattcaaaaattagccaggcatggtggtgggtgcctgtaatcccagctacttgggaggctgaggcaggagaattgcttgagcctgggaggcagaggttgcagtgagctgagatcgcgccactgcactccagcctgggcgacagagtctccattccccccatccccccaactccaaaaacaaacaaacaaaaacacaacttgctttcactttaccctatggacttgccctgaattctttcttgtgcaacatccaagaaccctctcttagggtctggatccagacccctttccagtaacacttctgtttttctggagaactcagagtaatacaatttgtgactgcgtcttgttaaggaactatttccctaccctgaggtcctgaagatgattttctttagtttctaaagatcataaagttttgcttttcaaattcaggtctttaatctaaccgggggttattttaatgtatgctacaaggtaggaagccattttattttttttccaaatgattaacaagttgttcagtgttattttaaaacaatccatctgtattagtttcccagagctgtcataacaaattaccacaagctgggtggcttaaaacaacagaaatttattttctcacagttcagaaggccagaagtctgaaattaaggtgtcagcagcactggttccttctgaagattctgagggagaaaacctcccatgcctctctcttagcctctggcggttgccagcaatccttggcttgtggacacatcactaatctttctctccatcttcacatcgttttatattctgtttccctgtgtcttctcctcttcttataacgacaccagtcattggatttagggcccaccctaaatccaggatgagttattcttaaaatcttgagctaattacatctggaaagaccccatttccaaataagttaatattctgaggttctgaggggacatgaattttgcggggtacactattcagcccactatatagcatcatcttttgctactcttttgcaaattctatttctgttgtttatccagtgtccatttatgtgtgggcagagtggtcattttataatataaatctctgatgaaatggttagacatttttcatgagataatcttatttaatcctcacagcagtgccgtgaggtagatgctactaaaatcacctactgttgagaggtgtgccagtcagcatttgctaagtatgacgtgataacaaacaaccccaaactctcagtgacttacaaaaagccaattgctttcttcatcacattacacatcacagctgtagattcactgcagctttgctctgtgtcttttcattccagggtccaggctgaaggtgcaggccctatccaagacacaacatttccagtggcagagataaaaaagtaagatttcagactcaaacatgcaatggcactccaagtttctgcttcgaactggcatgtatctctctagctcacatttcattggccaaaggaagtcatgtggttaagcttgacaatgggctggggaagtgcactccttcctctggaaggtacacaagtcacatggcaactggctaggatggataattctcttactggccaagggaagggcaaataatggagaaaaataatacgtcaaccacaggggttgagtaactttcccaagatcaaaccactgggaagggacagaggcagattcaaactcagacagtctccaaagccatagtgaactccatggctccctactgcctgttagatggaatccaaatatatttaagctttagggcattcctgcagcctggagggcccttctacctaatttgtgtgctgaattcactctttaaggctccactccaatctcaactccttggactcactcttatttgtcatgtgttccctctgctctaaggcccttgtacagtgttcccaaatgtttgcagtattttgggatgaaaggagtgaggggcacaagctgcaagtggactgtgctcctgaggatgagagcactttgcctacttttccacccctctaaactaagcttagtatcttgtgcttgggtgactctgacaggtcagccccgcatgactcactctgtaagccttcagcgcgggtcaccacaaggtcctggtttagggtgtgtgagttggtgggtggggaggggaggtggaaattaactttcacctttcaggaacctttcccttccccaggagaaggacaagtgtaagtccttcccttaagtagtctgggcaagtctctactcatcactcctaggaggactggggaggtcctggaaggtgcagaggaggaagctctgagaagtagaaacagcaccaaactgcaccatagaagactttactaatttgtccaaatgacagaatttaccttctctgagcttcagtttccccagctataaagtggcaacaacactgatcttgccctcctccctaagttgctacaaaaagacatagtaaaaatctttagggtgccgggcagggtggctcacggctgtaatctcagcactttgggaggctgaggcaggcagatcacctgaggttaagagttcgagaccagcctggccaacatggtgaaaccccatctctactaaaaatacaaaaattagccaggcatggtggcaggcacctgtaatcccagctacttgggaggctgagacatgagaatcgcttgaacccgggagatggaggttgcagtgggcaaagatagtgctactgcactccagccagggtgatggagcaagactccatttcaaaaaaaaaaaaaaaaaaaaatctttaagaatgcagccttgaaatcgcacagacttgtactggaatccttctcataagctatgtgactgagaaagttatagatcttcataagccattacagctacctcccagggtgagaaaattatgtaaataaatttcctaacatatactaagtactcaataatgttggctattcctatatgagatgatgaaacttattattatatagggaaagtcccagacgaggacccatttttgaacattgaaaggagggagtacagaggctaacttttcttagaattggttgcttcttttagccaagtataaggtgtggctcaaaggaatgaggaagcagttaatgaggtgacagggcacagaatactgtttgtcttcacagatcttgggggagggatacagtggttagctgaccttcccaaaagatcagagatcctggtgtcttgtccacccacagatgcaggccacttgactctgtcctgtcccctcctaccagtccagtcaccacgttctggtgaggctgcctttgaaataataataacaatggtacttgtactaatgatattattactttgaagtgtatgaaggctttctaatacatcatcccagttatccttcattatctctctcccattcacagaatccagagttaggaaggatattgcagatcattctgcattttacagatgggatctctgaaatttgaataaaggaagggatctactcaagggctgggatttacctgagactacacaataagttaatggcaggggcaggactagaacctgcagctcctgactaccagcctagtgccagtgcctctttcaagtcacacttgcattggctttccattcccatggcctcccagtctattctttttttttgttttttgttttgttttgttttgttttgagacgagtttcgctctgtcgcccaggctggagtgcagtggtgtgatctcggctcactgcaacctccgcctcccgggttcaagcaattctctgcctcagcctcccaagtggctgggattacaggcacccaccaccatgcctggctaatttttttgtatttttagtagagacagggtttcaccatgtttgccaggctggtcttgaactcctgaccttgtgatccaccctcctcggcctcccaaagtgctgggattacaggcatgaatcaccgtgcccagccccagtctattcttttatctcctggaccactgcagtggtttcctactggtcctgcctgcctctgatccctccccacccatttcttctacacatacagtcacataattgtctggaagcacagctttgatcttgtctttcccttcctaatagaacttgcccattttttcaacttgagaggtcaccaggatcctagttcaatttcccaatgaagacttaatctttccttgaatacatatattgacaaggagttcatcactcccaaggtggtccattccattcttgggtagctccaactgttagggagttctttatagtgagctgaaattgtcttcctggatatccccccactggaggtgatgtgatggaattctcttttttttttttttttttttgagaccgagtctcactgtgttgcccaggctagagtgcagtggtacaatctcagctcactgcaacctccgcctcccaggttcagcaattctcatgtctcagcctcccgagtagctgggacttacaggcatgagccaccaagcctggctaatttttttgtgttgttagtagagacagggtttcaccatgctggccaggttggtctcaaactcctggcctcaggtgatctgcctgcctcggcctcccaaagtgctgggattacaggtgtgagccatcacacttggcccctttttgtttttttttttttttagacagagtttcactcttgctgcctaggctggagcgcagtggtgtgatcttggctcactgcaacctccacctcccagattcaagacattcagcctcccaaatagttgggattacaggcatgtgccaccacgcccagctaattttgtattttagtagagacggggtttcaccatgttggcgaggctggtctcgaactcctgacctcaggtgatccacctgctcgaccttccaaagtgttgggattacaggcgtgagccacagcacctggccaatggaattctttcgtatccattctggcagcaaatctgtagtcattgtttcataggaaccaggtcctggatggactaggtgctgaggagaacagcatataaatttgatatggatccttccctcagagagggtggcctaggagtttgctaatgcagaattttttgttttgttgattagacctaaacgaaaggaaacaaagcaaatcctctttctgtatgatagtccttcagaggtgtggagatagtcaccatgtctactctgtgctttcccttctccaagctatttaaatcattcatcatacagcatggcgtccaggtcctctacgttccggtctcctgtagacatgctccagtccccctaagaatatggggctcacaaatgagcttggtggtccagctgtgatccatctagggcagagctggcccaacttttttttttttttttttgagacggggtctcactcttgttgtccatgctggagtgccgtggtgtgattttggctcactgcaacctccgcctcctggattcaagggattctcctgcctcagccgcccgagtagctgggattacaggagtgcgccaccacgcctggctaattttgtattttttttttttgagacagagtctcaccctgttgcccaggctggaatgcaatggcacgatctcggctcactgcaacctccacctcctgggttcaaccagttctcctgcctcagcctcctgagtagctgggattaaaggcacgtgccaccacaactggctattttttttttttttttttttgtatctttagtagagacagggattcaccatattggccagattggtctcgaagtcctgacctcgtgatccgcctgcctcggcctcccaaagtgctgggattacaggtgtgagccactgtgcccggtcaattttgtatttttagtagagacagggtttcaccatgttggccatgctgatctcaaactcctgacctcaggtgatctgcccgcctgcctcggcctcccaaagtgcttggattacaggcatgagacactgcgcctggcctcaactctggtttccgttgatagaatattcatattcactttctcctccttcctttcttcgctttctccttcctccttctctttgttccctcctccctccctccctccctctctctcttctttactccttttctcccttcctttctttctttttggcagcacgttgcattgttgagcttgaggtcaactaaaacctttaagtcactttcactgtaattactgttgattgagattctttctacactgtatttggggcacttgctcatttggaagggcactgtccaatatggcagccattgtggccattcaaatttaaagtacttaaaattaaatacaattattattttgcatttcctcagttggactagccacgcttcaagtgctcaatagccacagagggctagtagccactgtatcagacagcaaagattcaggacatttccatcatcatggaaagttctgtgggactgctctggtttggacctaagagcaggagtttatacttacaatctgaggcacgtcatcttgagagttccagctcagcctccaaaactgctgagagctttaagaaactgattctggtttccggagtcttcattttccctcccaacctcatgacaacagtagatttgatcaacgtttcataccttcctctgcttcatctaaaaccaactgataaaaatacccagcagaacagagaggcttgcaatcgagccctctatgtgacaccctgctctccagtcccatgcggcagttgtgcagtcatttaacaaattaggcctatatcctaggtgctgtgctgggtaccaggtacctacaaggaagtcagaagacatcaattaaaaaaaaaaaagagtcctgctgagttgggtgctctagtagttcaaatgtctttgcttcccattcaaggctgcctcttctgtctgttttgtggttgttaaaagtggaagcttggggctgggcacggtggcacacacctgtaatcccagtgctttgggaggccgaggcaggcggatcacttgagtccaagagtttgagaccagcctggccaacatggtgaaaccctgtctgtactaaaaatacaaaaattagctggatgtggtggcatacacctgtaatcccagctactcaggaggctgaggcaggagaatcacttgaacccaggaggtggaggttgcagtgagccaagatcgtaccactgcactacagcctgggtgacagagtgaaagtctctctcaaaaagaaaaaaaaaaaaaacggaagcttgggagtcagcttcccaagtttggatcctagctctgccactttagaagctatgtgatgtctttgtgtttctgtttcagcatgcataatgtgggaataagaataacctctaatgttattgtgagaattaaacgaattaatgcaaataaagatcttagaacaataaatatagtaagtgttcctaaccggtgagttattatcagttcttattgttaatcataatcttccttcctggacaagccatgttcagtcctgctttggggcctcagttccttagttttgccctcccttagtttgtgtaagtccttggaggcccaagccctgcctctccttcctgctttcttatgttctcagctgctcactttgcacctgctcttagtatcctatacctgaggcatggaccacagtgaagaaccagaattgttgggcttcatcttggctctgtgctgcctggaggggagacctaggataggctcctgatctgcaaaatggggataatcccagctgccacttaagtgagacaagtaggtgaaagctacttagcaggcctttgcatgtcttgacttccagtaaaaccctggcaagtgaatgacatttgcatcttccctgtttcttcctttagcatctaacaaaggaggctcaggctcattattccgggcacttctggagggcctggccctgccccaggagccctagggcaggaattcctttctttatctatagaaggcagacacttcatccctgccccatcttctttcagatgctatcttgggctcgctgaacacgggttagttcctcctctctcctagcctcagtgtgtactccaagaaggacctaaaggagcgcctatacgggccgtggtggttataaccctaatttagaaaagcccattactttgggggtgtttgggcttgtggagggtgggcgtcgggatcccagagccagggactcagcccttggagagtccccagagagtccagaggttgccacctgcgaggggctggaacgcactgggctatcctccgcgagccctggccgcgggaacaatgggagcgcggcgtggaaaagggtgggcgtgggccaggtcctggctggaggtagacgaggtcggcgagctgggcgcggggccgcggggttaccccggggcaccgggcacagagccgagaagtctaagctagggaaaatcgaggtcggcgctggcgggaacccgggaggacgtgggggccccgggtggggtctgctcctcttcttcgcccggcctctgagcccgccgcagctcaggttgacgccgggcccacgtggggaagccggcggcgggtccccagcgccgggagggttcgcggggctcagccccttcctctgctcccctccccgggaccggcgcgcggccccagctccggcggctccggcggctccggcgctcccctggtgttggctgctcgccgccgctgcttgctcgttcgcccgcccgctgctgcttggggggccgggatcgccgccgcctcctccgggggagccggccggggcggggcggagcggcgagagggggtgtggggggcgggcgaggagggggctgagcgccgtgggagggagagcaggagcgagcgcgcgagagagcggggcatttctgcgcagctctagcgcgcctcggagcccgccggggcagccgccggacaccaggaccgcgagccagacagctcccggaagccgcgccgccgccgccaggttagccgcacccgccgtccccctccgcgtcccggggaccccgccgcgtcgggtcccgcgtgtgcgtgtggggtggccgccgagggcggcgggctcgattcccgatctttgggcactgacaggccggcgggccggctccaggagccgcgggcttcggttcgtgtgtgtggggactgtcgcgggtttgtgtgtcggggctccagtctctgggtgtgtgttaggtgtgagcgcgcgtgtgcccgtggatccgtgcgagcggctgctcggtgtgcgcgcgcgtgcgtgtgtgcgccgggtgtgcatctgtgtgtgcgtgtgtgagggtgtgtgccttgcgtgtcttcgcgagtggtgcgtgcgtatctgggtgagggtgcgtgtgtctgcgtgtgtctgtcggtgaatgtatctgtgagagggtgtgtccgaatgtgtagcagtgtgtacacctctgggtgagggcgtgtgccagtggcttcgcttgtggctgcagcctgtggcgggtgtgggtgtgtgtgtgcgcgcgcgtcgctgtgtgcgcgccagtgtaactcccgtgtgtgcgcgtgtgagtgcgggtgtgctcccgcgtagcccccgtgtgcgtgtgcgcggctttgtcttcgcactgccgggaggaagcggtgggggcggcggtccaggcgccgccgccgctgggagctgggcacctggcctgggcggtgggtggcggcggcgggggtgtcccttccccgtcgggcagagactccctgctggcaggtgggcggccacaccccgggggtcgggggaactgggctgacagcagagcccgcgttctgacctgagctggagaggagggcgtgtcctgcttgaagcccgtgtgcgtgcgtgcgtgcgtgtgtgtgtgtgtgtatgtgtatgcgtgcgcgcgcgtgtgtggatgtgggtgtgggtgcggggtggtggtggtagcaacagcagtttccaggctggtgaccagccggttcagggattcatttcctgttgtggccaggggacatgtcccctccggcctccccccagccccccaccagacctagcctgtgccagtctcacccgtgcagggctctgggtgggtgggaaggtaggtgggtagaagctcaggtgccctgaaaaggactaggagggagaaccactctcttaaagggccagctcctcactccagggaatccctcctcaggagacctctctactttgaaagagatgtctctgggtatgtccatacccctttctccaagtactggtgcatacaggcatttctagatctgtagtctgtgtgcatgtgtcctccctgtgtacttcttgtacatttgggtgtatagtgaacagtgaaaatgtatctcttgatgtatatgtgtgtgtgtttttataggttctggtatatttgtttttatgtatgtgtagttgtttgtatattagtctgtgcatgtgggtttgcagagaagtggcattttgctgccaaatggaatagaagagaaacattctgtaccgggccacgccatttttgaaaaactgcgtgaaaaggaagtttgggaatttagtctgtggctttgtgggtttcagataccggtactgaaatgtaggtaggttggattttgactgtgatacaagggtagagagaagtagagtcttataggaggaagaaattgttcagagagaaggatatccaagtgcaagaattcttccattagttccagttcttccccgtaacgtcacatccccctttgctgcttggcttgccaagatacaggacacaggatttggagtgcaaagggagggagctgggagtgtaaaaggaaggaaggtggatgggtgataggattgggggccagcagcagatttctgcaattcttaaaaatgtttccctgccaaaagcagcagaggctggggaaagctgagctttctgtcccctccttgaatcccagaatcccgggacatgggaaaagctggcctggagttcatgagctctggagtctgggccagagatcttttgccttgttctgtcaccgagactggagtgtaggcagtgtcacgatctcagctcactgcagcctccgcctcctgggttcaagtgattctcccgcctcagcctcctcaatagctgggactataggaatgagccaccacgcccagctaatttttttttttttcttttttgagacagagtttcactcttgtcgcctaggctggagtgcaatggcatgatctcggctcactgcaacctcctcctcctgggttcaagcaattcttcttcctcagcctcccaagtagctgggattacaggcacccaccaccacgcccgactaatttttgtatttttagtagggacagggttttgccatgttggccaagcaggctttgaactcctgacctcaggtgatccacccgcctcggcctcccaaagtgctgggattacaggcatgagccaccgtgctcggcctaatttttgtatttttagtagagacagggtttcaccatgttggtcaggctggtctcaaactcctgacctcaagggatctgcctgcctccgcctcccaaagtgctgggattacaggcatgagccgctgcgcccagcctgggatcttcttttgactttagccaaccccttcatgtgtttatctcttcacccaacactttttattaagcttctttatgtgaaagggtctaaactccctaagccttggtttacctggctaggcagctagtgggctagattttgggactttgatgacccttcccttgctcagattgctagagtttgtctcgttgttacccaggttcaggaatccacccttctagtccccagagatcctggccatggtcctcactactaatctccccaccaatatactctagtctagagctgtggttttttcacctcaccaacagcagcagggttacctgggagtttgttagaaatgcaatttattggcagggcgtggtggctcacgcctgtaatcccagcactttgggaggcgaggcgaatggatcacctgaggtcaggagttcgagagcagcctggccaatatggtaaaaatacaaaatttagccgggcatggtggcacgcgcctgtaatcccagctactaaggaggctgaggcaggagaatcgcttgaacccaggaggcggaggttgcagtgagctgagattgcatcactgcgcaccagcctgggtgacagagcgagactccatctcagggaaaaaaaaaaaaaagaaatgcaatttcttggttctcacgccagacctaggaattgataactctggaggtgtggcccagcaatctatgttttaacaaacacaggtaattcttatttactctggagctcaagagaggtggagacagggagccaggaaacatctattaattgaaacacttggaaagcctcccctgtccctcacacaggtgcctgaaatagcactcaggccccacctggtaggtaggaattctgctttcaagtcccaggtcttatgatcttggacaagtctctccttcagtgactaatgcaatgactctttgacagtgtgctgtggaccaggttctgagcgaggggtttccctgatctgctcagtttctccaattcttactttgatctctaaggcccttcaggatccagttcctgcccacttctctggacaacagccactttggccttttagttcatctaggcaccatgagctcttttgcttctgggattttgcacatcctgttccctttgtctagcacactcttcccctgcttcttatcttgattaactcccactcttcatgtttcagctcaatagtcactttctcaggggggcctttgccaactctctaggccaagtcaattttccctgttacacattcttagagctctctgtgtctcacagggcttgtgagaatttgtaattgttgtttgtccctttactagactgtaaatgccatgtgggcaggaacttgcttactaatcttcttagtgtcccacacagtgcctgacttatgatttgtgttcaataagcttgtcaaactgagttaatttataaaatggcagatggcactaaatgatacccaaagtttcgtttcaagccctgacaatgtgtaatccaagcaggcttcagccttttctcaagttgatttacctgtctttttcaatgctgcatctcccatctcctggctgtagatttgagcactcaccgtgggtccaggcccatgctgggctctgctctagtggaggcaggaggaggctcctcaggagacacagcctagcttgggttctgtgtcttcctggattaggtttgtactggaatgagaagaggaaaagtattgaaagaggaatccaaatatctgcgtccatgccttgttatgtgactgagggccaatcactttccccttttggcacgtgtccatctctgtaaaatgaaggtattgggatgggtggcacacttagtagtggttactagcactggctctacagtcattcggggcttgccatgtactagctggggggactagggcaagtgattccatttcctcatttccttacttgtaaaacaggaccagtactagtatctgtttcacaggattgttttgataattaaatgagataacatccttggaatgcttagcataatgtgagtgcataagaaacatttgataaatgtcaactattatgaccattattgctactccacaattcagctcaacattcttgaaggcctttgtattgggccctaggcctacaaaaacagaaatgaatccagcagtattcacaggttgggggtgggagcagacatgtaaagatgcaataccaccgcaaggacaatgtacaagctgccagggtgtggctgtttatggaggaaaaggcttcctggaggacagagatggtgtttgggctggattttaccgtctgggtatttgaaatagcatgtgcaaaggcagaacggcttcttaggggaaccccaaatagttccacatggttggaataggaggtggtgagtggcagggatgagggtggaggagtgaatgactggagataaagctgagaggaagattagggacagatctggtgcaggccaaagagcctgagcaagtcctgcagacggcagggagctggggaagaggagtaagccaaccaggaaggatcagatttgcatttcaaaaacacagctctccaggtggtgacagaggatggttggtctgggaggaagggaaggactgttgacctggagacctgggcacagaggctgctaaacaagctcaatgggaggccccactggggtggatagatacctagaacaggctgttctaggaagctttttcctctgtaagcctgtcttcagcctggtttcacgacagcctggccctggaaggtgcaggagaggtgagagtgacttctcatgaggagcctctgggtcctctttaacctctaaagctgcctaatgagtgggaatctgaaaaacagagtttgagggtcctaggtctgctactcaaaggatgcacagtgtattaacttcctaggggtgctgtcatgaagcacgcaaaccaggtagctttgaaccacagacatttactcccccacttgtggaggctagaagtctgaaatccaggtgtcagcaaggttggctccttctggaggctctggggcaatctgtttcctgcctttctcctagcttctggtggttgccagcaatctttggcatttcttggcttgcagctgcatctgcctctgtcgtcacgtggctttctctctgtttcatttcctcttctaaggacaccagtcatatgggatttagaacccaccctagtccagtatgacctcatttgaacttgagtaattgcatctgcaaagaccctgtttccaaatatggtcacattatgaagttttaggtagacataaatttgggttgggaggggacactgttcaacccaatacatgcaggaagttggggaggagtgcatgccttttagttccacagggctacatccaaatttaggctttgcagtggagcctctatgaaatggagacagtaggccaggcatggttgctcacgcctgtaatcccagcactttgggaggccgaggtgggcagatcatctgatcagatttgtatttcaaatttgagtgatctgaggcggattattcctgaggtcaggagtttgagaccagcctggccaacatggtgaaacgctgtctctactaaaaatacaaaaattagccaggcgtggtggcgggcacctgtaatcccagctactcgggaggctgagacaggagaattgcttgaacctgggaggcggacattgcagtgagctgagattgtgccactgcactctagcctgggtgacagagcaagactccgtctcgaaaaaacaaaacaaaacaaaacaaagaaatgggacagtagcacctacagtagtgtcatggtcatgagacttgatcaaaataacagatatgagcatgcctaatgaggtagtacacagtaggcactcaatacctacttcctttccagctctcccttctctgcacttaggagcttggacaagtcacctaatcttgctttactttcctcatctatcaaatgtgaataatcatcatccagccctgcctacttcaccaaattgcgatcccaggagataatgagaaagctctttgtaaattgcttaagggcttgtagctgtgatttttaattataataataatcatcataataacccttggccattgtcatatccgctgcattctcctcagagcccagcccagcccagcccgctcctctcctgagacaggtcctctttgcctgtttgtgctcagaggcatcccatgaagtgtcgcctctgtctgagttgggaggaccttagagatggtccttgccgttgcccttattagcctgaggagggaaacatgctcagggagaaaaagtgacacccgcaaagtcacacagctggtcagtggtaattggaacaccttatctgtggctcctgtcttcagtctgaacagtgctttttccctagttgcaactttaggcccagaagcaggagctcagggcagatagaggcctggagtgggctctgcatatgttccagaggtgaggatgcaacaggagagtgtcctgctgtcaggattagaaccccaagaaaggggtccctgggctctgagtgagcaggctgaatgggccggttgttctgttatcactctggctatggccatctctgcctactctggtgggagggccaccatgcggggctctggagtctagatgtaacccaaggcttcagtgtccctgttgacagccagggtggcatttctcagcaggtcctgtccctctaagccttgccttggtgggtctagggaaagctctgggaaagagagagggcttatactgtcctggtagtttctggcaagtcatcttcctttccccccacactggggaagccaggcccctccttggccccttgattcttctttcctttcctccctcctcttctcagtttgctctctcccttctgtctgctttctccccttccctctccccaccttgtccccagattagaggtctaaagatagagtctccaggcccacttcaggtgggtggttttgggtttgcttgaggccacctagaattagaaagtctagagtcttcctcataagaggctcactctggtgacttataatcaactgcttatgtttattggcttactgtgtgccaggccctgtgctaagcgctttacatgccttatgtcttttaatccttacaactaccaagtgaggcagagatgatgatccccgtcgtattacaggaggctaaataacttgcccaaggcctacgcagtcctcagccagcaagtggcacagctgggatttcaatctagatctgtccgaagcccaccggtactcttgagtctttcctatatggcctgtgacagagcctgcgggagcatttaggtgtccacagaggggcatgcatttgctcaaattcagagaacaaattcttgactctgaaagaagggcttccaatcgaggaatcttccctcccaggcctgcactctggcagcacctccgggactggcctttctacagcatcagccttggggcccgccaaggctctgagcccatctggttctaggcagctgcccacctgtaggagagacactgcatcggtatggggggtggcgacagggcccatctgaaggtacttgccttttttcctagttattgttttgtctctggccacctcaatttttcattgaatcgagtcttccacttaaagaagcatatcatttgcaaagagcattacttttgtctcctcacaagactgcttgggagcttggatatgctgcaggctcagtgacgggtggaactctggaagaagtggggagggaggcagagaccggagccaggagacccaggttcagaggtacatatccaccagaagaaaaaaaggagctggcctgagggccagagggaggtggcctggagagagggaggaataggaaacctgctctcaccccatgtgcagcccgggagtccagactccctcccagtcagggctgctggtctcagactgtcactcaggaatctgggcagctgcagtcagcttgttgagcctccacccaccccaaccgagaccattatgttggtcagcctggctcagcccagccacctgcctgcctgagcaggtggctcagtcagaagggaccttggtgaaggagtggtggctttgaaacttctatccacagagccactcttcataggcaagggagcagaagttcaatttgtgaaacacctaaaagggggagcagcttagcaccccaccccattcccctccctcctagggttccctaaggctgggcctctcaaactttgtttccccctaagagcaacaaaggtgagcatgctaaaaagcaaaataaaacaaaacaaaacctgtgtgccatggctcatgcctgtaatcccagcactttgggaggctgaggcaggtggatcacctgaggtcaggggttcgagaccagcctgacatggtgaaaccctgtctctactaaaaatacaaaaattagctgggcatggctgcatgcacctgtaatcccagctactagggaagatgaggcaggagaatcgcttgaacctgggaggcggaggttgcagtgagctgagatcacaccattgcactccagcctgtgtgacagagtgagactctgtctcaaaaaacaaaacaaaacaaaacaaaacaaaacaaaaaaaacaaaaaaacccagcactctttttccagacctcacccaagagattcaaacccagctgctccatgggcggggtggggggtgggcgtcagatccgaggtagggccccggaagcagcctgctgtaacagtctccccatcgagatgattgggacacagatggttctcagattgcccttgtagaaggctggcctcagatgttcatgaacttctgaaatatggcatgcacaatgttaagagtgtgcattgtccctaggagaggatccacaggcaccgtctgtcttggagtcacaacccatacaactttagaactgctgtcttcagggttgttttgcgcagttggagcctaacgtctagagaaaggtcaccagggagccaatggcagagctgggtggagagggctggtctctcatgcctctcagcacattactggctttgctgtgaaggtggtcagggactgtagacctgtccctctgtctgggcctcagttttcctagctgtaaaatgggggttggacaggataatcccaagtttccatgcagctttgatctgtggttctggaagtcaggtctcctgctgcccagtccaagttctttgtccttttccttgctcctccctggcttcacccaccactggggggacctcccacttttgcatcttccatcttcagagattctggacacagcctgcattctggccccttgagtcccttctgtctgaccacatgcccaaatgctcaagtcctttctccctttccgtccccactcaccataattgagcaaggtgcctgtgaatctggggaagctcaaggtgacctctgttcagagctggacatgtgggtcagtgccaaggggagggctgcgaaaactaatttcctgaggctcctgggacacacccagtgcttcctatgtctttgccctagctccctctgttcctccctgccaagaatgccaccccctccattccccaatcactgttgaaatcctgtctgccttttcaaggctcagctcagatgccagcctatgtcctacaaagccttgtaagccctccccctcactccaagatgaaatttgtctttaactcctctgcactcccttagtaccttatctgttcccctctgggggatgagttctttttggtcttagctttatccagggaggtggctttcaccgggttgtgagcactgggatgccttatgtcttattctttgcttcccagcacctagcatggggctgtgcacagaacaagttcttaattgaggcttactaagtttgcagaatctgcctccagctctgggctgagctggcctctttacagcccctatggcccatgtcactggcaggccatggtttctcacagggcccctccctctatttgtggattggagggaggccaagtagggcaataagaacttaaattccgatcttgattctgccatttctgggctgtgtgaccttgagcagatcacttcctctctccgagccttaattttctcagtttaaaacaaagaggtagggatgacaagtctactgggggcttgggtgaattaactgaagtgctttgtgtaaaatgctgataaaagcattgtaaagaacaaatagctaataaatgattatgagttattattttttggttaatagttattaccattgtttctttttctttctttttttttttttttttgagacagagtctcactctgtcgcccaggctggagtgcagtggcgtgatccagctcactacaagctccaccttctgggttcacgccattctcctgcctcagcctcctgagtagctgggactacaggcgcccgccaccatgcctggctaattatttttggatttttagtagagacagggtttcaccgtgttagccaggatggtctcgatctcctgacctcatgatctgcccgcctcggcctcccaaagtgctgggattacaggcgtgagccaccgccccggcattattaccattgtttcaacaaacatctactacgttctgagcattgtgctgcgggggccagggtgagagacaaaaaaataataataacaggagttccttggtctccagggtcttaaggtcaaatgaggcagtaagactctagtacaagaagtcagtgtctggcagagatgtggctgagtgagttgaggggggagtcattagtgtagaggtgacaacaggctagaggtgacatttgagccagaagggcatgaagtaggaagggcaatgacaggctgggaggagacccatattccctgtggagaatggggaagtggggtgcatatttggagagtttcaggaaggaggcgggaaagagcagagcggaagcagagttagaatttccctgcagaaggggcatagggtcggcaccccggatggagcaggaacttcaagctttgttttgccaagaagaatttgggggagtgatgactcatgatgccgccattgagagtaagagagagactgccgggaagatggggtagaaaagtgaggctttatggcagagagagtggggaccagggaggtggggggacattgtccctctctgcccaggcttgtgctaagaatggtggcaagtgggcttcagttccgggcttctgcagggctgcctgtttatctggccaagattgggatttgaacattgatgtctgaagttaaagcatgaaatgactccagaaatgtcagaatctctatatgtcagagcccaccagcagaagtgatctctgaatccacctccctcatgccacgctatgcaggtgggaagcagaggcctgggaggaggagatggcacccaagaacaccgagtgaactggcctcgcgcgctctggatgggctgtgcgcactctggatggacctaggcctgtgttagggtgaggagggggccagggaacccatgaaggatgtacatgacaagcaaacgttaagctgggagcagtctgttgctagggtgtgtgcgtgatcccaggtgagtgggatgtgagtgggccggagccgtcatcattccaggctttccttccggaaaaggagaaagggccacataggtgggaaccaggggaatattgggatgtgggggaaatcagggggtggcttgagaagaggaggctgttgccaagcagcaagagacatgactgtatgagaacagaacaggcaccctagcgtctgtgggcctggcactgtacagccctggactgtagtggtatcacctccattgcaggggaagaaaccagggcttccaaggtcagagctaggaagaatggagtcaggagtggcatccagggctggaggacttcagagccatgtctctggcatgccctgggtggcagccattccagttcttgtgaggtcctggggtcaaaggggtcaaggaggtactcagcccagggcaagtcatcttttgcttcctttcacttcttctccatcaatctgcccattgagcgggcctgttttcttctactttacccaccccccttaatttgttgatgaaaaatatttattgagcacctattatgtgccaggcactgcccttgatttcatggaacttatgccatcgcttcttggcacagagggctatcccacattgccagggagtgatgggaagaaggaggggagggggccactggccacttctctctccctttacatgagcccctccctcttctcagcctctatccccttgcaaatgcccctagccccagatggttcttgttggaactacctcctgctgaaatgaaaaccagtcagagttaattgttaaacctaatagctggtgagagtttcactctcctgggctggtgggaggggggctgcaccccaggggaggggtggagtcacccaggtttttctggctggtacctgccaccttttccctattctggaatctgcttccagggccctctcctcccctcctccccagggggcaggctgccacctggccctttcccctgcctccagctaaggtgaccctgggaggtgagcactggctctggccttagtccaagggcctctgggtgagtgctcttaggggaggtgtgggggagggcagggtgcctagccctggagacccgtccagaggccaggcagccagtggaccttgctggctttgcctcctgctgggtgtgggtgggggaactaaggatggtgccacagtggcctaagccctgcacacaggaccactgcctgtgcagcccatgccatgccgttccgctctccttcccttttgtcctcttcattgagtttcttattctgggccattctctgccaaaagactgggagatttgggcaccctgagaatagtggcaaaggcttattacttctagaaggctgagcctcggggtaggcccctgccaaagtttagggacagagctcagggttccaagtcagcaggcctagtcaaagctgggtgactttgcgcaggtgacttacctctgtgagccacagcctcatcctctgaacactacaggagttcctattttggggaggtttgaggggtcagtgaaggacactgggtactcagatcccattgtcaccatcactgtgtgggcaccagaggtaaatattaattttaggttcagtagggttttgttgaatgagtagataccattctattcagaggtaagctcacagaggtaagtcaactttaccttcgaggcttagctctgggctagggccaaggaggtcatcagcccaggccctcaaggacttgactgcagagctgcagctgccctatacagcagccattagtcacatgtggctagtggacatgtaaaatgtggctagtgccaccaaggaactgaccttttgaactctgtcgcccaggctggagtgcagtggcacaatcattgcaacgtctgcctcccaggctcaagcgattctccttcctcagcctctggaatagttgggattacaggcatgccccaccatgcttggctaattttttgtatttttagtagagatggggtttcgccatgttgtctgggctggtctcaaactcctgagctcaggcaaagtaatcccaaaggatttcaggcatgagccaccaagcccagccaaattttaaattttatttaatatttaattttatttgattttaactaatttaacattttaaaagaatgctcccttcatttattgacaaactatgcgtgtttggaaacttagatttgagaatatacctttttttttttttttttttttgagaaggactctcgctttcgctctgttgcccaggctggagtgcaatggcatgatctcagctcactgcaacctccgtctcccggcttcgagcaattctcctgcctcagcctcctgagtagctgggattacagatgcacaccaccatacccggctaatttttgtatttttagtagagatggggtttcatcatattggtcaggctagtcttgaactcctgacctcatgatccacctgccttggcctcccaaagtgctgggattacaggtgtgagccaccgtgcccggctttttttttttttttttaaatcataaaggcggctgggcatggtgcctcatgcctgtaatcccagccctttgggaggccgaggtgggcagatcacttgacgtcaggagttcgagaccagcctggccagcatgtgaaacccccgtctctactaaaaatacaaaaattagccaggcgtggtgcacgtgcctgtaattccagctactcaggaggctgaggcaggagaattgctggaacctgggaggtggagattgcagtgagctgagatcacaccactgcactctagcctgggcgacagagtgagactccatcttaaaaaaaaaaaaattgtaaaggcaaggagaagctaaatatcttatgaatatttagcatctgaatcaagatgtgttgtaagtataaaatacacactggatttagaagaggatgtattaaaaaatgtaaaatatctctatagtctttttaattttagttttaatttttttttttagaggcaggttctcactctgttgcacaggctggagtgagtggcatgatcatagctcactgcaacccttgaactcctggacttaagagatcctcccacctcagctagtagctgggactttaggaatgtgtcacctcacccagctaaatttttttattttttgtagagacaaggtcttgctatgttggccaggctggtcttgaactcctggtttcaagaggtccttccacctcagcctcccaaagtgtggggattacaggcatgaaccaccgtgctgggcctatagtattttttacattgattacatgttgagatagatatattgggttaaatgaatatattatgaaaattaatttccctcattcctttgtgctttttaaaatgtaggtactaaggccaggcacgatggctcacacctgtaatcccagcactttgggaggctgaggcaggcggatcgcttgagaccaggagttcgagaccagcctgggcaacatggggaaacctgtctctactgaaaatgcaaaaattagccaagcatggaggtgcgcacctgtaaccccagctatttgggaagctgaggcatgagaattgcttgaacctgggaggcagaggctgcagtgagccaagatcgtgccactgcactccagcctgggtgagagaacgagactctgactcaaaaaataaaataaaataaaatgtagctactatacacttttaaattacatatgtggctcgcattgtatttctatttgacaacactattgtagacagagttgagttgggcacatttgattaataacagaagactacataaagactagttatttggggaaggttgggaggtcaatgaaggacagatattccccacctcaccccagcccgggccttgccccttggtggaatgttaccctggacagccccatagccttgaggatgagttcagggcttcttttttttttttttgagatggagtctcgctctgttgcccagactggagtgcagtggtgcgatcttggctcactgcaagctccgcctcctggattcacaccactctctcacctcagcctcccgaatagctgggactacaggcgcctgccaccacgcccggctaattttttttttgtatttttagtagagacggggtttcaccgtgttagccaggatggtctcaatctcctgacgtcatgatccgcctgcctcggcctcccaaagtgctgggattacaggtgtgagccactgcacccggccgagttcagggcttctgatggcaaatgaaaaaccttggtctgggtcctcatcctggccacgcccttcacttgctctgtgtgtgaccttgggcaattctctttgctgaacttgagcctttcatctgcaaactgagactaatggtggttgaggggatggcctgagaaataatccaagtgagtatttagcacagtgcctggcatgcctaagcagtcaagtatttgctgtgtggtgattgctactactgttagtgcgggggctgttgccacgacagtactgttgcatccagcagctcatattcagttattccatgtgcctcaaggggacattggccagaggggaagaagttaaaatagcttgagggtgggagttgggatggggatttggggctgctttgtatgatacctcaagagattgcttggttttcaggtagctccttggatattcctttctgcaagtgatcaggcaaagataaattccattttacagatgaggaagctgaggcctgtgaagggaaagtgacctggctacacagccggaacctgaatgcaggacattctgcccctgtcgtggtggtattggagccagctaatgccaccattcgaggttgcaggagcagcacctgaccagaaatccagagcttgtaagcaatggttattattagtcttctataactggaaaggatcttgacattgtttttttttttttttttcttgagacggagtttcgctcttgttgcccagcctggagtgcaatggcgcaatctcggctcaccgcgacctctgcctcctgggttcaagcgattctcctgccttagcctccctagtagctgggattacagacatatgccaccatgcctggctaattttatatttttagtagagacggggtttctccatgttggtcaggctggtctcgaactccccacctcaggtgatccgcccgcctcggcctcccaaagtgctgggattacaggcataagccaccatgcccggccttgacattgtttagtacaacggtctcattctgaagtcgaagaaacagagatgagagagacagagcaagagggagaaagagagagagaactgctgatcacatagcaagttggtggccaagctggagctgattctgtttgcttagatccaggcttcagctcagccccagcaggatggatggccctgcttgtcagtgcccttctctcctgcccagtccccagagagggcttctgagaaagaggcttttgtttcatcagctcctcctggtttcctctcaaggtagctacacacatgtgcacacacacacacactcacacccattggccccagtttgcatttgttacacacacacactctcacatcccattggcctcagtttgctttacacacacacacacacacacacacacacacacacacacaccattggcctcaatttgcatttgtccctattccaggtttaaaggaccctgaaatttgaagactatccacacatatctactttctggatatccacggagagaccatgggctttttcatcaaggaggcctgagttcaaatccttcttctatgtctgattctctctgtgaccttgggcaagtcacttgttcttttttgacctcaacttcctcatttgaaaagcaggaacgggaatggtatgtgtacaacctagtggtttagctgggctccagaccccagccgcagtgtaggggtctcagctctgccacttattcactgcctggtcttcagtgagtcatttcatccttctaggtctcagtttccccatctttgaatggtgctgctaccttttggacagttgtgataaggcaccttgctgagctgttcacaggcatcatctcatttagtccccccattagccctgggagcagacacttttactcctattttccaaatgaggaagtaaagtgacttgccctgggccacataagtagtaagtgttagaaccagaattcaaacaggtctgagttactccagagcctaagctcataaaccactgtgtgttcttcctgttcacctgagtttcacattttacatgaagtaggaacacctcatcccacctggagactgactgttctgagtgtgtgagtccagggtgcctgtagcttctccctccaagtctcctgccccattgcatactaagcctgacctgtggttggagctcaaagaagattgagaaaagtacttacatactttgagtgaattacaccagaacaggatgtgaatgctaaaaagaccccgagggaggccgggcatggtggctcatgcctgtaatcctagcactttgggaggccgaggtgggtggatcacttgaggtcaggagtttgaaaccagcttggccaacatggtaaaacctcgtctctactaaaaatacaaaaaattagccgggcgttgtggcgcacgcctgtaatcccagctacttgggagactgagataggagaatcgtttgaacctgggatgcggaggttgcagtgagcagagatcgcaccattgcactccagcctgggcgacagagcgagactctgtctcaaaaaaaaaaaaaaaaaagagaaaagaaaagactccgagggatcactgattccaaccatatttatttcacagatggggacactgaagcaaggaaaggccaagtggacagcagggggtataaccatggcacctgaggaggcatctggaggttggggcccctgctctcccttctccccatacatctagtccaccagcaagttctggggataccaccttttaaatacctcttgagtctgtccacctctttctgtctcttctgcaaccaccctagcttaggccctcatcatatctccgctggataatcacaacaacctcctaactgatgttcctgcagcttcccctgcccctcttccatcctctaccctgtaagccagtggtttctctttgctcttacaataaagagcgaatcttctccttggcctccaaggtccttcgctgcctggcccctgctgccgcttcaggtgcatatttgttactttctattttgctttccgccttgtcacaaggcctttttgtttaacaggttcagcaacttccctaaggtgcctcagagagtcaaatgccagcctctcaatttccagcacatgctgggctcatgaactcctgttctgaggagctaacgctgtttcctccctctaggtgcctgactgacagaagttcttgcccccggggagctggtgtggacagaggaggggtgagtgttctggaggcacagacttattctccttctgctgaggttggacgaagaggtcttccaggccctcggcctctcgatttttgacatatttgactgctggggaagtgtgaggctttgtctacgccacctgtttctggtggcgctgaaaacgggggccatgctggggaccctccctggttttggcttgttttgggttaggggctgaaatgcatattcatcaagctctgtattcaaaaacaggctttgcctctattgctcatccatgccaccgtggctggtgaaggacggtgctgggcctggaagctgccccgtggcccttgcctgcctttgcttcaccactcctaggtcgtagactagattcaggagagagtgctttcatcctggccctgcccgttgactactacatgaccttcctttctactggcctcagggtcacatcaacattggtggatcaggggatgggggaaagtagggtcagactaaatgacttgttttcaaactttccagcagggaactctcctttttccattgcaccccaaagaatctcaatgtacaaaacagctaaaggggttgcagtgtgggttggagttggcgtggggctggccaattcctcagcccccagacaatgcaactgaccttttcttggctttatggaagacactttggaaaccactggcccggggcgtgtcaaagcttcttcccaacttggaggtgctgtgattctggcagggcgagggagtagagagggaactcagccaatggagttacattgattgggaaatttcgaagtaacatgcaaatgtcactgtgatgttattagtaaggcacaattgccagggctgtgatgttgtcattctggagtcctctggtttttaattttggttcaatgtgaagtatctttgtacccctagggaaactttccatttgtgtgtgtgtgtgtgtgtgtgtgtgtgtgtgtgtgtgtgtgtgtgtacacatgtgtgtgcacctgtagggagcgggaactatggggaatgaagtgtggctgagccaggctgggacaggtagaatgaatggtgggcagagctgggagcatgttgctcctgggggtggtgggggtagggggtggctttagctcggttaaaaggagcgatttggctccttcctacaggggccccatggagatctctgggcaggaagcatcgggaacaaggaatcctctgtccacagccacagcacagccggacagaggaggtggattaggagttcccgggagggagcctgctcagcctttccctgacatttgggcaaatgtgtggggagatgcggagctcaaggtatgtgcgcatagggaaggtggggctccgttaaggggaggttgagatcggctcatacatttattccacacgttcctcaagcttcctgaagcctttcaaggagccaagctcagaagcagacaattctgtaggagtcagagccaagaaagatgagactctaggtattaaccaccatcagtttactgaaggagacaggaaatgtgagagataatagactttcacaggcagctgggtgcagtcggagctagttggccgtgtgtctagagccccacattcaagttcttgctctacagtaatggtctcatgacttcccctttctgaaccctcatttctccttctgtagaatgcagatgaacacatccgccctagctacttctcagtgcttttctaagtgtcaattagaatagagtttttcaaatctctttgggcaacagaaacccatattgtaagcatttgtagcagaacttgtctggttctggggcagtttacccagaattttgccctcctcgtggcttagtttcctgggtgcttttggagatacctctgcaaattcccagggctctaggaagcagggtctaaagaccactgggtcagggtattcttgagaacatgctttgaaaactgcccactgcaacccaggtgataggggtggtgccacatacacaagagtagttataatactggcttctgcttggccctgcccatggacagcactgaccttatcttagttagggtctatacaattgggcatggcttttttccagaaaccagtgacaaaaacttaactcaaagtggctttaaaccaaaaaatgactttagtggatcctggggcagttcatgggactgaagaatgaagaatcaggttgactctctctctgccatcactgcctgtctctcccttttaagctgtcctgtgtcccagcttagcaatccaaacagaaaagggagactctttttcttctagaatctgtatgtcaatccaagggaaggactctgagtggttcaatcactgttgctgggaggataggaatattctgagtggccaggtgtgggtcaggtgcctacctatgtagctaacgtaggggcagagctagcaccagacaccgggggagtagaaggctgttggcagaccacgagaacatgctaggatattagtggagctctaggttgtaacagctcataggcctgcagggggctgtaactcccctcttcagttatagtaatgcaaatgccaacaataataacaatagctaatgtgcattgaattactctccctgtaccaggcatgttctattgttttatgtgtattctttcatttaactgtcatgacagtctttgggtaggtcctattattactattatttccccatattatcgatgaggaaactgaggccctgttaagttaaggccacactttgagtaagtaagggagctgggtttcaagcccaaggtgtctggcttcagagaccatgctctgactattgcatctccagcctctgtttggtaggccaagtggccatcttgcctttgcttgtatgcacggagctcacgacttacagaggcagcccagttccaggttgcactgctctgcctgttggaaagggcttccctatgcagtgcacatgtctacctccatacaaatccatccagccagcatatggctgtgtgttaggtgtttcaggagatgtcaagacaaatcatccataaacctgcctgaaaggtcatcatcacaataagtcacattacttacattgtgccaggctccatgctgaactctttatgtgcattatctcatttaattgcagcaacagtccaggtgctgtggctcacacctgtaatcccagcactttgggaggccgaggcaggtggatcaattgaggtcgggagtttgagactagtctgaccaacatggtgaaaccccgtctctactaaaaatacaaaaattagccaggcgtggtggagcatgcctgtaatcccagccactcaggaggctgagacaggagaattgcttgaactcgggaggtggaggttgcagtgagtcgcaatcgtatgactgcattccagcctgggtgacagaataagactgtctcaaaaatataataataataatagttgcaacaacaactccagagagtaggttctgttattgtccccattttccaggggaaactgaggctcagagggaataagtgactaagaaactgcaaagctgttatttgagttcaggtctgcctagctccagagcctgtactacaacccagtgcagtcagctatgtcccctagaggggaatacatgtgtgcagatgtgattgtgacacagtcagcatgcaaattgccactgagagggacaggaaaaatgcaactggagtttagaggagagaggtcagggaaagggggagaaggggacatttgatctaagttgaggggaactaggatttggacattcagttcagggagggatctccaggaaggtttggaagagagaagcaggggtagtgaagtttgggggaaccaaagagctgagttgggggtgaggatgaggggtgttgtggccagctgtgctttcaggccccacagaaggtgccttcttcttccagactgttctcttctgagacgtgaagaggtttgatcttctccaggagagctcaacacaggtgcccatttccttcctttcctcctgatgtgaggtgggcaggccctatctggagggtagacaaggcacctgggcaccaacagctgtcagtgcttcattcccttcttcctggtggtgaatggcaggaaaaatggtccattccccggggatcagcactttctccagacagcacagtgctccaggcaccagaatggctggactagccattcaggagggttctccatgtcctccctggacagcaggctgaagcatatgcctctcacccatggaggggctcctttctcctgtgccctcccttagctaatctcatccatttgtcagaagttggataatgcccccagaggcctgggctctgtccctaaagtgcctttggatttttctccaaacaacacaggtgggaaattgggggaagagtatgatgtagtgctaggtgctctctcagtttcaaaggatagaagaatagcagttatttttcttgagctggactcacagtgagtcaggggttttattaccccattttgcagatgaggaacttgaggttcagaggaggaaaatgatgacaaatgcagttgtcacatgaaatatgaatggctgtgccattgtctgctgaaggagggacataagtgtggagactcaacatggaaaactgccccttccctcccctgctcttgcccaccaattcctcctcctgtggcagtggctctgaaatgctgactctggctaccctagctgctctccatcctctcttctacatggtagcagatcattcgtcctggattgctgcctgcctgagagctggaggggtgtctctgggggactcaggcctcaggaatgttgcccacgtaaggtccagacatccagtatttcttctgtgactcttacagtctctggagtccctggatttctccaatccttcttgaaggaattccagcatttctgtaaggggaaaagaggcagaggacagaagaattctttcataattcttctgtccttaggatccttcaaccccatggcccttatcacctggctcacactagaactagaatcaaagtccttcatattcttttctacaaagggcttttcaatttatcatctcatctgattttccttgtaatcctgagagataaggcaggaagggtataattatccccattttgtgggtgggttaactgaggctcagagaaggtaagtaacttctccaaggttacacagacagagcagggctagaagatagaagccagtgtccaggaatcctgaccttacttctcagtgcccagtgctgacagctactgggacagcctctggctggcctcttagtccctctctacatccaggactccctctctggttcagcccagtgtgggggaggagtcatgtccccagttcagaccttccaggcttcctaaggcctccagagtaaagcctcactcaccacttctgtatttgagagttccccaaatccagtcccaatccactgctcttgccaatctcagctaacataacaggctagtcttttccttctgacaaagtagacaagattagccatttgttaggggggcatccctctgtgggatgttggatgaatgggtttcagcctgcttgctgctgagggaatagacagggaaactgaggcaagggtcagcacaatcgctgcattcaggacagcttagagaggcaaggctaagaaaaggcttggactggactaatacgatgggcctttccccaggaaaatctactgctttgtttcattaaataaaacacagatggtgcgtgcctataatcccagctacttgggaggctgaggcaggagaattgcttgaactgggacctgggaggtggaggttgcagtgagccaagatcgagccactgcactccagcctggactacaagaacaagactccatctcaaaaaaaaaaaaagaaacacagagtgtactgagtgcctatcttttgctctacttctatcccagagaatatcttccaaggggcaccttaagctttgtcagaaaagtagcacctgggccaaaccagaaccagagacccaggttcctaaggagcattggagtttacagctcagcacttgccagaacaactgggattctggaattagtgatgatgattgcacaactccgtatgtaaatatactcaagaggagtgaattgtatgctgtaaagtggtacattttatggcgtatgaattatatctcaatttttttaaaaaagaatacctgggattatattagagcatgccctgcacatgtaggtgcttaatagatgcttaatagatatttgttgaatgaatgcattaatgaatgtaaatttatttatttattttacttaaaaattttgttttgatataagaacatcttataaagcacatttgtttgatcctcacagcagctgtaaggaggacttagggcaagaataatgatccccatttaacagataaagaaacagaggcctggaaagatgaaatgacttacctagggcaattgaattagagttttagagagttgaaataagtttttatgctatcttctccagcccttgattcattaagcaaaccttaaccaagcacttcttctataactgagctatccctgagatgctgagatactgatatcaatgtgacaagacctctctcattccccagtagttgagagggagactgggatgaagaaccaagcactgacatgactaatcacacatgactatggtgtgattagtactgaagggaggtgggctcaggggctgcaatgcccaaaggggctctggccagccctggggagagcagggtgactgccctggaggctgacagctgactggaccaggaaggatcagaaagatggccaaaagaaagggcaaggtgtggctgggtgtggtggctcacgcctgtaatcccagcactttgggaggctgaggtgggcagatcgctggaggtcagtagtttgagaacagcctggccaacatgtgaaaccccatctccactaaaaatacaaaaattagccaggtatggtggtgcacgcctgtaatcccagctactcaggaggctgaagcaggagaatcgcttgaacctggtagggttgcagagagtcgagattgagccactgcaccccagcctgggtgacagagcaagactccatctcgaaagaaagcaagaaagcaggaaggaagggaagggaagcggaggggagaggaggggaggggaggggagaggaggggaagggaggggaagggaaggaaagggacaaggtgggcagggtagggtatcttcatgtcagtccagggtgcccttgaatcctgtgatgagattagggctggctttgattcagaagaacaggaggagtcactgatgaattttaagcaggcgaggaacaatgctagattgcccactgccctccatccagggcaagcccatttcagccctttcttcaataccactctccctgcccgccctcctcctctgtaccctctgcgctggtcacacggtgagcctgatagaggtgaacttgagcccaggggtcctctctcccagaccaagctagtccttgcttcatcactccaagtagccctcctcagtctgagtccacccctgacattgctgttctggccttcagctgatcacagctagaaactgtcggtaacattagcactaagcgctaataaccattaaaacagatgaccatttaccaagcccctactctaagccaggcgtggttataagtgattcatttctgtatcacttaaagtcatttaatcctcatcctaagaaatgggttatagtataatccctagttggcagatcaggaaactgaggcacggaaaggtgtcataatttgcctaagtattggtgaagctgggattcaaaaccagaggctgtgctgagtcttatccgctggactgtagagcacacaggaggaaaagggcagtcagtccagctgaagactgagtgagcaaagagggactggtccggtgaacttggcaaaccacagaagcacacacaggccttgaagtccatacattccatgtgacgggcaatctgccttttgcctttgaatctaggatttctgaagctctaggccaaccgtgtccctgtctgtttgatgtagcctggctggagcctgagccctggacaaccagattcatattttctctctcatctgtttctctttctcctaccgaccaccccagtgcttgggcctagaaatggattctgcctccagctgctcctccactgggtcctgatttagtccgcaaatttttattaaaaactccaattttattggagttcctaccatactccaaacactgtcctatgtactgggatacagaggcacacatggcaggtaaacacatgctatggtctggatgttagtgtccccttataatttatttgttgagatcctaaccgccaaggtaatggttttaggaggtggggcctttgggaggtgatgaggtcatgagggctccaccttcacgaatgggattaatgtccctataaaagatcccagagcctttggtagttcatgagcatgatgattgggtgttcacgcatgggggtgagatgtgccgccttcaaaccttgttacaatgtacaatgtgaacgcattacctgtctgacatgaaaaaaaaaaaaaagagagcgatctcagagagctagatttcctttctaccatatgatgactagaaggagccatctctggaccagaaagcagccctcagtagacacggaatctgctggcaccctgatctttgacttctcacaaaaatgtgagaaacacatttttgttgtttatgagccacccagttgatggtgtttggttatagcagcccgaaagcagaacttcatatcgttctctggcatttcccaaggggtagtgacaaagatgtctcttggttcttccatgggatgcatgattttgaatttggaaaaatacctctgttgggggaggtagcatgtgctgggagcccatgtgctgggggtcaggcttgggctgtgatccttcctcttctgtggccatgctgggtgaccttaggctggttcttgcctctctctggtcctcttcctccccatctaccaaaaggggagatgagaacagtccctggcatttgtggggcatttgcctggcctatgtgtcatgtgctcacaggagcccaggctgattccaaggtcccttcctttctaacatttggttcctgggtctcacaggccctggaagtgaccactgggctgagtagctcatcagcttccccacactgaagcccgaggggtctcctgctggcttctgagagctgacggaacaggttccagcaaggcagaccctgacacagaagccagacctgtccagcagggaccccatacactggtgggtgtaacctcttattatttcctttgggcaggaagtggggaaggctggagtggaggtggagtgagagcagaccttcaaggcccctgaaactacgcacttaacctagttctgccttgtgaagggtggtgaaaccaaagcccgagaagggcagctttccccaagactttgccaggtgtcaccaaactatgctggaacccagatctactgatccctgcctggtgtcgtgtgctcagctgttcctgggccttgctcacggagtaggggagggcaaaggatagagcgtgtgtgcacctggccaggtggagagtggccacattttatcccgatgctatggttgtggggggagaagtgtctccatgtcatttgtcatgtttccctgcctcctgtcatgtttctcagataagttcctgggtctcttgcccaactgacgcaaacagcctataggttgagtgtccagaggagggggcgatgcagagggccggcctttgtgccaaatggggacaggaggcctggtgagtcctgctgtacaccattcctggtggtggagccgctcagctgtgagcgcccatcctttctctgggcagtggccatgtggcctaggctagcaggccctggaagagcctttctgtgtccttcctggttcttggtgtctaccgcctcacccacacccctgaagctctgggctttgctactcagctctggcacagagactggtttggcaggtttggccacacccatgagcagtgcgatggctgggagctggggtggagcaggcctgaggaggcagtgctgccctgtccttacccccatacccccaaatcccagcctcacttctgccgccttttctacctttctcaagggaggcttcctgggaaactggaaggcagaagccacgcagacttctagtcctggttccactgcttactcggtatgtggcccttggccagcccctttcccttcttggacctcagtttcagcacctgtacaatggggctttgggctcagtgatcctcagacagccacgttgtatgattctagttggggttctacgattttctctccatccctgaacaaacgatagagcactgactgccacaggttccacctgggtaaaatgagtgcctcgacccttgctcgcttcctggagatgtcgataggatcagccaacatcctagcaagcatccagtctccatgggaaagttttctttctatagtctggcctgcccttatctggttcaagcagaaggagagaggatacctagagatggggctttctctaggccccctcccatgctccacttaccctgagaccataattgactgagaaccaggctttctgaacgtctccatgatcgggggggaggggcagaggtagagaacaagaatacagaggaaaggccctcgcacttgctgcctcctgttcctcccgaccttcagaccagcccagggtctagtttgggggaagaggggaaggcagaaaaattccaccactgctacaggccccctctgtgacactgggaaaattgtgtactttcgctgcacctcagtttcccgatctaacgaggaagacacatgtcttccagatcacatgtcctcagaaaatttaagttctggtttttttgtttgtttgtttgtttttgagacagaatctcgctctgttgcctaggctagagtgcagtggcgcaatcttggctcgctgcaacctccgcctcctgggttcaagtgattctcctgcctcagcttcccaagtagctggtattacaggcatccaccatcatacctggctaatttttgtagagacagggttttgccatgttggccaggctggtctcaaacacctgacctcaggtgatccacccaccttggcttcccaaagtgcttggattataggagtgagccactgcgcttgggcagaaaatttaagttctgacaatgtataggtcagaagaaggaatgggagttagatgaagaggacattcccagcctgagatgggggctagagagagaagaaaaagggaattaacattcagtgagcacctatgtgccagtgctatgccaattactttgcatacaatacatacaccatctatattcccaagtctcctttccaagtggcagccagagtgaactttgtaaaacacaaatttggctgggtgcagtggcccacacctgtaatcccaacactttgggagtctgaggtgggcggatcacgaagtcaggagatcgagaccatcctggctaacatggtgaaaccccgtctctactaaaaatacaaaaaaaaagaaattagccgggtgtggtggtgggcgcctgtagtcccagctactcgggaggctgaggcaggagaatggtgtgaacccgggatgcagagcttgcagtgagccgagatcgcgccactgcactccagcctgggcgacagagtgagactccgtctcaaaaaaacaaaacaaaacaaaacaaaaaacccaaaaaacacaaatctgactatgtcactcagtgactttcctctgcccttagaataaaatctaaattccttaccatggcgttcagagccctgagtgagccggttcctgcctcccccttccagccatctatctctattggtctccatagatcattggaaattattctattggtcatttccgtcagccacaggagtcttctctgttcatttagcaaatttattccagtctcaagacctttacacatgcttaggttccctctgcttagaattcttttcctggctctttgccgccttggctccttcttatcctctacgtcgcagtttaatttagtcctcccaccccctgcactgcttttttcaccacctcttgattccttcataatgcttatcacaatttgtagctatttgtctttttcttttaatgtcatgttcactcttgattccatgtggcatggcgcacagtaggtattcaataagtatctattggatgaatgaatgaatgaattgtaaggaaatgagagagtgctggttgagtgcctggcatagggtatggctcttaggaggtgctcaataaatggcagcttttagtgagaactgacatggcagagaaaataaatacccactgatagattgcatacatggtgggtaggggaggcagcgggtaattaagattggaaagtgatgcactcgtgccagatcttgggggtccctgatgctcagccaaagagtttagacttcctgaaagagtagctggaagtcattgctgggccattaatgtaactataaagccctacttctaagatgtgggctcagccactttgcgtactcaaggggctgtgctgtatggtggtggggttgcagggttggggacaaacccagagagagacaggctgggaacctttctggtgtcattctctgagacaggctattcctacaggcccagaaggaggggacacagttaggagcatcctgtgttttctgattccacatggccattacattgtttctggggagtggaggataggggtgacctaagagtcagatgcttggatttctatttgagcccctccccttatcaaccgtgtgacttctgctaggttcatttgcatttctgattctgtttcttcatctgtaaacaggctgctgttcgtacctgcctcatggttttcttggggaggatcaatgaggtagaacctgcaaagggcttagcagagagcctagcacctactgagcgctcagtaaaggtgagctattatcttccattcaacagtgggggattcagaaaggtagattgaaccacaagtgcacagaggcatgaaacactttggagtggcaggagtttcctgtgtgtgttggggacggcaaggaggcaagtggagtggcaggtgggtccagctcctgcagcccgtgtatattgaccaggagctggcactttatctggagagcgatgaagacactgcagggtatcaggttgggaatgatgtgatctgatttctggcagtgggaggatgaattggaagggtaaggctggagaccaggagacggatggtagtctgttggtgtggcctggtgagaagtgatgggcttcatctcaggctcatggaagtgtagaagagggaacagatcacagagtgagtagagacagagaacggacagtgtggggccgatgggtcttggggaagggagggggaagaaaggaacttgtcctagatggctgcagactttctcgatggggggctgacgagattataaaaccgaaagtatggacagtgcatgtgggttttgatgcctgtagtttgacttttctgggaattcagtagctccctgagaaacctctcttttatctgactctctgtgtagaaaatctttctaaaatctctgaatgatgactcctccattagggatgaggaaggcctcctgtggggacaccgtgcatacctcctaaggaggggtggcagcttggcctcctttggtggtaacaaagctggggattttatttggaagctgtatttcagagtctatcagttttcttgtgattttcttcaaagcatgtacaaaaaggcagttccagttagtggaattttttttttttttttttttgagacagagtttcactcttgttgcccaggctggagtgcaatggcgtgatctcggctcactgcaacctctgcctcccgggttcaagcgattctcctaactcagcctcccaaatagctgggattacaggcatgtgccaccacgcccagctaattttgtatttttagtagagactgggtttctccatgttggtcaggctggtctcaaactcccgacctcggatgatccgcccgcctcggcctcccaaagtgctgggattacaggcgtgagccaccgtgcctggccagtggaatgttttgtgtatttattccacggctctggaccaagactaggcaacttttcaagagtggtgaaaggtaagctcctgcgtgctccctctctctgttattttcttgattggtgtggactggaagctcacattccagagaaacttaggtcttagattacccgtctaattttccttatggatgggaacaagagaaggtgcatgaaagttgctcatgattgtgaataatgccacagctgggcttggcccaggcacctcactggcagctacaggctttcccatggcatgcagctggcactgcctctggagaggaggataggggtgatgaactgatgaacatcagcacagcccccggcccatctcagaggcacacacctagtggcagcgggagggcccccgcagactggagaggactcagctattattgtcctaagcctctgacagtgaggctcatccataccccgcctcccatctgagatgagctcagagatatgactgaagtttcagggctaaaaccaaagggattgggttggtacccccttcttatgagaaaaggagaggagagccctgtctgggtctggcggaatacagtctgcatccccaccccagctgattgcagtgatgaggagatgcctttgtctgagttgccaggggaaccaaagtttctgccttcttctaaggccctgattggctcctgctggagcttaagctttggtgaatggaagggcctctcttctgcctacaccttccctgaggtgagagacgagtaaggctggagtccccatggatgcactgtgttggtgtctctgtcctacctccttagctgggggtgctggatccccttgctcattcgtctttcactaatcctgggcagcatctgccccaggcctttcatccttctaggtccaggaaagctagcctaagaatcaggaaaactgtataccaatcctgacataggcagactcactcttggccttgggcaggtctcttctccctgggcctcggtttccctacctgtaaaaatgaaggcattgggctaaactctggtccttccagctctgacttccctgaccacacagcccagatcccctctctgaccttccatggccctcctcgtgcctcttgtgtgcctctgactgcattctctctcgtaggttcccttgtaagatgcaggtcagaatagggggttgtaaccagccttgagcattgttttggttttctgtaggaaaaattgtgctccctgaagcctgtcctagaagccctacatcctgcaacccctcttgtcctcatctgtctcacctggaccgagccccagggtcagaagcccgggggaacgaatgatgggtgcttgtgtctgttgcagggtggggctaggcagtgtgcagaaaggagcatgtgggggtgggcgggggcagctggaagagccctggagctcagcagtcctgggttccaggcctaatttgtctacctgctggctatgtgaccttgggagggtggctcagttgcagtctccccatctatcacacaggaataataatgccacctcacagggcttgttgccaagatgacatgtctgccatacaggagacaccaagttcccttccctgctctctcttctaaacaaggcagggagatggggaaagttcagactgaggaggggccctaggctgcaagacctgaggtgccccaggccgggccttagatgctgctcattcctggcagtgccaaaaagcagggagaaaaaagtattggccttgggtggatgggggaggctgtgtgtcagagctaatgtttaaataacacttttaagatcctccagggacctcaaatgaggatttttcagatgagctgaaaatggagcaaagtaatgagactgagctcactggcaggaaagggagcagccttaattggtactggccctgccttggccccgtgacactcattaccacaggctgcccaggaggatgacccgtgcatttgggctgtaagcaatgtcaatttcttagcatggggtgatggggttgcatctggtagtgactcagccctgcttcttgtcgactcaccaggttgagggtcagagaggacttcttagttggccttcagagcctggtttagtttttagctttgtgacctagcctctctccacctctggggtctagaggcagcagccagacctggccactgtctgtcacaggtgtggtgggaggcagggatgggatgttgaagtcaggcatgagttgctgggggaccttccctcctttgctgaggtttgcctggggtcctggatgaggtgggtggagagagggaggaaggggcattctcagaagaaaaaaggctggtgggtgtgtgggtgggtgaatttgtgccaatgagatgtgactctctgggcaagcttgtgtagcttacatggaggaggcacagaatctaagggacatgtctcaaagaggctgagggatgggcctaagaagccagcatgggtgggggtgaggggtgggtcctgggagtggtttggtttgcgagtccctgtggaaacacaggtggtagaattggtgaatggtatggaccaagagtcctattctgaagacaccagaaaattctgaccaggctcttgtacgtgaggcctcttctgttttgcttgggctggactgcggggtgaatggccacgggtgtggtaagttaccgcttctcctggggggagcctggtttgcattgtaaatactgctcctggagccactggtcatggtgggggcactttttcagacgccttcctggggaatgtgtgagggccgattgttagatcattcttggcacctggtttgcattatgaatgcagttgggaggcataagggcaagcattgggtcactagcgggtcccaggccaccctgaccccaggctcactgctcccgaagcactccctctccttggtctctgggacagcacaccccactttctggctttctcactctggcctgccctcatttgcctgttgctgctcctctccttaactgttcagtgtgtgggttcctcagggctgcattgcagttattgtcgtttttaaaataataccgttttttaattttaaaaattcaatttattcatttattttaaaaattacaaatgagagctcattatgttggccaggctggagtgcagtggcaactcacaggtgcaatcacagcctcaaactctttgactcaagggatcctcctacttcagcctccagagtagccgggattacagagtgtgccactgcacccggcaggtttgttttttttttttgttttttttttttgagacggagtcttgctctgtcactcagcctggagtgcagtggcgtgatctcagcttactgcaacctccgccccccaggttcaagtgattctcatgcctcagcctcccaagtagctgggattacaggcacccgccaccatgcccaattaatttttctatttttagtagagacggtatttctccatattggccaggctgatttcgaactcctgacctcaagtgatctgctcgccttggccttcgaaaatgctgggattacaggcatgagccaccttgcccagcagtgtttttttttttgttttttttaattaaaaccataataacatagtaccaagatttgggaaaacaggaagcagaaaaaaattactcctgaatatgattgggagcttggagtgtttcctttcaccagttttcctttgctctttcttgcacagtcataatttctaccgcatcatcagtactgtcctgcatttttctcttaatgttgtatcggaagctgccttccgtgtcgttactgaggattctattaaatacacgatcaactcatcccttttcctgctcatggatattccggctgtttctagtttttgctattatgaataacagtgcaatgaacattgcataaaatgttcttcctgtatttcagatgatgatgtctcttggggtgaagacccaggaagagaatgctgggtaaaaggctgtggctgccttagaggctctcagtaaacttgccaaactgctatgccaacctttaacccccagcatccagggtgaatggcaggaactgttttttatttttctctctctctctatttgatttttaaaaatttctctctctctctctctctctctctctctttttttccccgagacagagttttgctcttgttgcccaggctggagtacagtggcatgatctcggctcactgtaacctctgcctctgggttcaagggattctcctgtctcagcctcctgagtagctgggattacaggagcccgccaccacacccggctaatttttttttttttttttgagacagaattttgctcttgttgcccaggctggagtgcaatggctcaatcttggctcactgcagcctctgcctcctgggttcaagtgattctcctgcctcagcctcccgagtagctggggttacaggcatgtgccaccacgcccagctaattttgtatttttagtagagatggggtttctctatgttggtcaggctggtcttgaactcctggcctctggtgatccgcccgcctcggcctcccaaagtgctgggatttcaggcatgagccaccgcgcctggctaatttttgtatttttagtaaagatggggtttcaccatgttggccaggctagtctcaaattcctgacgtcaggtgatccacccaccttggcctcccaaagtgctgagattacaggtgtgagccaccacacccagcctgttttttatttctcttaggtctgaagagcctgttccttgtgtgtagggactgctcccaactgtcctctgtccatgcattcattcatcctaaggcgggaggcagaatagggctgtggtgtcaggctgcctgggttcaaaccagcctcccctcttaaccaccttgtgtccacttcctcagctgtaaagtgaacatcatgacagggagctacctcacagggtccctgtgaggctttctgtgcatgaaagcatggaagacacttgaaatactacggtaagccaggatgacaatggtcaggcctagagagaggaaggggctgatctctcaccacctagtgatgcaggggcagagctgaggccagaatcaggcttcctgcctccagtgctctctttccctgatgccaggctactgctgtggatggtgtggtttatggcgtaggtggccctctgttcaagaatatgtgggaggggtggagggcctggatggatctataaggtggggtctctccctttcctcccagagccgtcaccttctttctggggtgctttcccccacaaagttatctctctaggttagagcttggggccccagctcaggcctgttccccagaggtatatccaggggacatctggccccaaggaatctccctggctagcccttgaggagggcgtttcagtctggagggaaaggtgagttctgaggacccctccctaggtgactgtgtcagtttcctaatgctgccctaacaaatgaccatatacttaaaacaacacaaatggatgaccctagacttctagaggtcaaaatctgaaaatggaccttatggggccgaagtcagggtgttggcagagctgctaggggaggatcctcacctggccttttccagctctccaggccacccacatgccttggttcatggccccttctagtagctgggtccctcccacctctgcctccgtcatcatatctcctccgattcccccaaatccccttttgacttacaagaacccctgtggttacattgagcccattcagataatctaggaccattctccatctcaaaactctttacctaatcacctgtgcaaggtcccttttgccacgtgaggtaacatattcacctgattctggggatgaagacatggacatctttgtgggcggggggggggggcgcattattatgcctgccacagcagccagtagcaaagatctctctggattactggacccccaggtcctgctggaattgtaccactagcctccaagatggagggagggcttgggggtccaggcctgatatgctgtggccggggaggggtatgagagattctgtatgatggggggcccggaaggaaggcagtgcacctgtgatagtgtgataaatgtgttcagtgaggcagacattgggaaatgtcacccctggccttcagaggtagtcctggtaggtgtgggacccactgtgaggcactgccacagaaagccaagcagcacccgctccacacaccaccatcactgctgtgtgtgtacacgtgcttgtgggtgtgtgcactcatctgtgtctctgcatgaatactcttgggagggccaaggaacaactcttgaaaaaggtcctttctgctcttgttctaagaaaaataattacacaagtgactaattttatccctaatcccataattactttattatgtagctggtgagagggcccgagctgtgcctttggctccactctggctgttagcccagttggcctggtccaccagcgttgagccccgccttgtttctggcctgggactgccatgagggcaagatgagttccattctggctgagatccaactaccctttggtatttggggtctgaaaagaccaccatttcttcccaccaagcccatgcacaaagtaagagcttgtgtttagggaattaagtcagtagattcaagagatctgggttctagttcacccctctcattaacttgctccctgaccttgagcatgccatttccctctggatctcagatctgttgtctgtgatacagggccctggccagcttaacactccatgattccatgaggagaaatgggaagactagagctttgagacagaggtaccttcttgctacctgctgaaaacataccccaatcatagcattaaagataatattaatagtagctgggcacagtggctcatgcctataatcccagcactttgggaggccgatgcaggcgtatagcttgagctcacgagtttgagaccagcctgggcaatatgcaaaccctgtctctacaaaaaatacaaaaattacctgggcgtggtggcatgcgcctctgtggtcccaactactcaggaggctgaggcgggaggatcgcttgagcctaggaggttgaggcttgcagtgagccgagatcacgccactgcattccagcctgggcaacagagtgagaccctgtcaaaaaaaaaaaaaaaaaagtaacaataatatccatcattacttgatagcaaaccttgtacctgattcttcatttatatttttctcattctatacttggatgactaggtgaggtaggttttacggaagaggaagctgaaccagcagttgataaagtgactcacctgtcatgaaatggcagaggtaggactgtagcctatgctcttagcctctgcctccattgtctttttctactgtataaataaatgaagggccactcagctaggaagtggcggggctgggatttgaacccaggtctgtctgtctccaaagttcttgccacctcccagaattaggcttccaggggtgattatactcttgaacttcaaatatgtaaacttaagcttgacacaacaagaaatagcgatggtgaaataaattggaaactccagtagaccagagagttggtagcccgaggttgtgttctagctttgccactggctcacgctgtgaacttaagcagatccccactaatccctaggcctcagtgttcccatgtacacgaggggtgggattcgatggtatccaaaggccttcctggtattgatggtttgacattctaggccatctggtcccagaaggtactgtggggcaggagaccagctcatggtggagaccaaagggtgggtgagttggcagccctagttttttctattacatttattcccacgagaatagagattgcttggactgtgtcccactgaacatttgcagaacaacttacccaggccatggagttgagaataaagagtggaggaggtagtttccaggctgttcctgcaaggttactgcccagcctgggctattagctcctcaggggtccaggtctgtcatctaccttgctccaaaggctgcattggtctcaggtaggcagaagcaatggctgcacgtctgtctgtgggagtctgtgagggtgcctaagcataataaataagaacactattttgtgttttctctgtctttttttttttttttttttttttttgaaccagggtcccactctgttgcccaggctagagtgcagtggcttgatcacggcccactgcatgcaacctccacctcctgggttcaagtgattatcctgcctcagcctcccgagtagctgggattacaggtgcatgcgaccacatctggctaacttttgtatttttagtagagacagggttttgcatgttggtcaggatggtctcaaactcctggcctcaagtgacccgaccacctcggcctcccaaagtgctgggattacaggcgtgagccactgcacccagcctactttgtattgtctattatcacggcctgcaacccactttccttgaaatattacgtttacttctcttaaaaccatatgaggtatgtatatggtcattcccattgtacagttgaagaaactgagactcaaaaggttaagtactttccttcagatcacacaatcagtgagggatagagggggatttgggattctgcctccagagcccacggtcttggccttagggactgataccacatgggccgaagcaataagcatgaggtcaggagtcagcgggtttggaatcccccctctgctcaccatctgtgtttccttgggcaagttactttatctgtctggatttccgtttctctctccataaaatgggtatattaatacctgccagttgggattgatttaaaggtcactgagatgatgggaagtgcaagtgtctagcctgtgggctttcacctcttgcccctgcctccttcctgcttccctctacatatctgaggctctggccaccctggaggtctcccacgcatagctcttagcttaggcctttgcacaagctgctcttctgcctgaaagttgctgtctctgcctgttgttgtaaagatagacttccttcacatctagacttcgatcctttactgtttccttgaggattctggaaaggggaaggggtgaggtaggttctcccacaggcctgttcagtgattatcaggacaacccctcggtaggggcagaattgagggtagcaggtagggtcctgaacaccctggaaatataaatccctccagaaaatttcctccctttatacttgacagcttaggaagggcgtgcatatgaggtgagtgtttcgtctttggatcattaaccttcctattactgtggtctcactttttcagttccccctatttctttggcatcatctcatggccttttactttcttgtttggttttcttgctagaacttacaaaaaaattttcaaaattgtggtaaaatatacagaacctaaaatttaccaccctgaccacttgttttttgagggagggtctctctctgttgcccaggctggagtgcagtggcatgcccttggctcactgcaacctctgcctcccaagctcaagcgatcctcccgcctcagcctcctgagtagctgggactacaggcacatgcaactgtgcccggctaagttttttttttttttttttttttggagaaacagggtttcaccgtgttgcccaggctgatctggaactcctggcctcaagtgatccaactgcctcagcctcccacagtgctgagattataggtgtgagtcaccatgcctggtccatcttaaccatttttaagtaagtgtacacttcagtagtgttgggtaggttcatattgtgtaacaccatcactaccaccatcttcagaacttttaaatcttttttctttctttttttttttttagagatggtgtctcgctctgttgcctaggcctgagtacacaggtgcaatcatagctcactccatccttgaactcctgaacttcagcagtccacctgcctcagcctcctgagtagctggggctacaggtgcataccgtggtacctgactaatttttttttttgtaaaaatggggttcttcttttgttgcccaggctggtcttgaactcttggcttcaagtaatcctcctgccctggcctcccaaagtaacgggattacaggtgtgagcctgaattttttaattttttaaaatttacttttccacggcagagtattgttctgttgcctagactgaagtgcagtggcacgatcactgcagccccaacctcccaggctcaaatggtcctcccatctcatcctcccaagtagctgggactacacatgcatgccaccatgcctggctaagtttttctttttttccttttctttcctttccttttttttttttttttgagacagggtttcactctgttgcccaggctagagtgcagtggctcaatctcggttcactgcaacctctgcctcctgggctcaagggatattcgcccctcagcctcccaagtagctgggactacaggcatatgcactatcacacctggctaattttttattttttgtagagacagggtttcatcatgttgcccaggctggtctcaaactcctgacctcaagtaatccgtatgcctcagcctcccaaagtgctgggactataggcatgagccactgcgctggggcagctaattaaaaaaaattttttttggatacagattgggtctcactatgttgcccaggctggtctcaaactcctgggttcaagttatcctcctgcctcagcctcccatagtgctgagattataggcatgagtcaccgcacccagcctgaatactttttttatgttttgagactgagttccgcttttgttgcccaggctggagtgcaatggcgcgatcttggctcacggcaatctccgcctcctgggttcaagcgattcttctgcctcagcctcctgagtagctgggattacaggcatgcaccaccgtgcccgtctgattttgtatttttagtaaagatgagttttctccatcttggccaggctggtcacaaactcctgacctcaggtgatctgcccgcctcggcctcccaaagtgctgggattgcaggcatgagccaccatgcccagccaaattttttaatatgaaaaaagtgaaactatatccattaaacaataactcccatttcctcctcccccaacctgtggcagctgccattctcctttctgtaactgcaaattggactagatacctcagataagtggaatcatacagtgtttgtctttttgtgactggcttttgttacttagtataatgtcctcaagttcacccatgttgtcatatgtatcagaattcccttcctttctaaagctgaataatattccattgtatatatgtacaacattttgtttatccactcatctgtcgatggacacttgttgcttccacctcttggctatgtgaataatgctgctatggccttggctgtacagagatctctttgacaccttgctttcaattattttggatatagcctcagaagtggaattgctgggttgtatggttagcactttttttttttttttttttgagacaagagtctcgctctgtcagccaggctggagtgcagtggcacgatctcaggctcactgcagcctctgcctcccaggttcaagcagttctcctgcctcagcctcccgagtagctgggattacagcttctccaccccgcccgctaatttttgcatttttagtagagacagggtttcaccatgttggccaggctggtctcgactcccagcctcaggtgatctgcccgcctcagcctcccaaagtgctgggatcacaggcatgagccaccacatccagccagcacattttttaaagccactatttattgcatgcttaatatgtgccaggaactgggttaatgatttgacatatattgcctcactcaatccctgcgtccactctgagtagtaggaagaattatccccagtttgtagctgagaaaataaagactcagagaggttaagttatttgctcaaagtctcacagctaggaagctttggaacatgcactggagctttgacctgccgccaaagccttgcttttaactattgtgacatgctgcctcccagtggcctctctctccacctgtctatagaattttctgcctctgttgtgtcccattttttttttctctcttgccttgtgtgtgttcactctctctggaaactttgaacaacttaagtaaaggccctttgactgccaagaagttttgtgagttggaaacttagagcgggaggcctgtaatttgctttctaatcatggtcctctggatttatagctgcctgtctcccagtgactgacaggctcttattcagcctcttgtggtgattgccttgtggatccacagaaagccggcccaagagggccagcttcctgggtacagggacgctgtacccccagagaggcagtgtgggaagggagacggcccggctaggccaacgaggattctcttggctcactgatttcctagcaacaacagaggcagaaaattttacagaaaggtgggaaaagaaaggctatgaagtagattccagtacaattgcctttttctgattttcaaaactatcagagcaaaaatattcctaaatttgtttcgagttttataagttcaagccagacttacggtttgcatgatagtcagttatctttctgtcatcctttaaaaaaaatttttttgttatgcaaaatttcaaacatacataaaaataaagagtatagtgtaatgcacttctgtgaacccattgcctaggtttagcaatgattaatacatagagtcacagcttgtctatccaataacacagaagtttaaatttttcctcattcacagcactagctcagcgcttcagacctagttgttgctcagtaaataaatagatgctgactgattacaaagcccttcccctctctgggtctcagtttccccatctgtgcagtaaagggataggattaagtgctttcttcttattattatttatttattttttttaagacggagtttcactcttgttgcccaggctggagtgcaatggtacgatctgggctcaccgcaacctctgcctcctgggttcaagcgattctcttgcctcaacctcctgagtagctgagattacaggcatgtgccaccatgcctggctaattttgtatttttagtagagatggagtttctccatgttggtcagctggtctcgaactcccgacctcaggtgatccgcccaccttggcctcccaaagtgctgggattgcaggcatgagccaccgtgcccggcctaggtggtttttttttgttgttgttgtttgtttgtttgtttttgagacagagtctcgctctgtcacccaggctggagtgcagaagcgcaatctctgctcactgcaacctctgcttcccagattcaagtgattcttgtgcctcagcctcctgagtagcagggactacaggtgcgcgccaccacacctggctactttttgtatgtttttttttttttttttttagtagggatgaggtttcgccatgttggccgtgctggtcttgaactcctggcctcaagtgatccaaccaccttggcctcccaaagtgctgggattacaggcatgagccaccgcacccaaccaggattaagtgctttctaagagacatggtagtcaaagtatacacttggatgtcagacacaattgtttttccatttattagctaggtatcttcaggcaagctgagtctcagttttctcatctgtaaagtggggatatgacttctcaagggtggttgtaagcactgaataaagtagctgttttgttgctaatacttttattattgctattttgaatattaatattctggttggaagaatccgtgtatttcagaaatgcaaaaataaaattggaatggactagaattcatgccctaggatttggcttctttttttgtcccagtcagcagataatcagaagcccaagaaatgaatagtgcaagaggaggcccagagtgagggccatccaggctgatttcatctcctctcttcccctgcccctgccgtgtgtgggtgtcacagcccccacccccatgagagagcccgactagccaccccctcccctaatgagacaggcccaagatggaagagcccacaggtggagagggtggtgctgcaggatgtctcgttgctaagatttccgaggaggcagcaagagcctgtttccaaagctgggagggaatgatgggctgatgagtagatgtagggcatgtggccccagatggggttttgtgggattctgggcaagggacagcagctgggagaaggcgctgggggcaggaggagggtctttgtagaatatggcccctttcatagactgtgggctcaggattacgtgttcatttcttccatttacctccttatctgtcaatatcagacctgcatgtgaatcctgattcactctatgacctttggcaagtgttgtgctgctgtacttgctggccctcagttttctcaccaatgggagggctaagtgaaacatgtataataaagtgctctgtaaaaaggaagacaaagtagaaatgtgaaggttcactacgactgtcatctttattattttttttttcttttactgtcagatgagggaatgggactctgttaggtttctatgcatgaatagggagccctggagggtacttccgctgtgagggcctgtgtcaggagactgtgggaattggctagatgggccccattagtgaaactccagggaacaactgaagagggcagcaaagttcaaagccagagaggcagcccaaggggggctgtggttgctgaaaggtgggggctctagtgagattctaggagggaccttcaatggttcaggccagaagctttgagagaggtgaaggtaacagacctttcttatataaatatgtttacacatatataccagaaagtaagcaacaaaacaagacccaaatgtacacaaaagaaataattccactatcataaaacaacgtctggtaacatgttttaaaatatttcctgtttgcttttttctaggcatgtacacatacatacatattttatagaaattggggccaggcacggtggctcacgcctataatcccagcactttgggaggctgacgtggacagatcacttgaggtcaggagttcgagaccagcctggccaacatggtgaaaccctgtctcttctaaaaatacaaaaattaaccaggcgtggtggcggggcacctgtaatcccaattactcgggaggctgaggtgggagaattgcttgaacccaggaggcggaggttgcagtgagccgagatcatgccactgcacttcagcctgggcaatagagcaaaaactccatctcaaaaaaaaaaaaaaagaaaagaaaaaagaacaaaaaacgtattttgtagaaattggatcatttgttacgtaccattttgtctctgcttttttacctgtattgtgttaagaacatgattatatagccacatatagatccacaacattattttgtgtggctgcgtagtatttcagcatatgtatgtatcactatttttataacgtagccactattattggacatatatattaactccaatgctctactttactcctgtatacagtgcttagacaaatgttcttatagccacatctttgtgtcattcattgttccctaaggatccattcctaaaaaaggaatttctgcgttaaacggtatgcacacttttaaggcttatcatgtactttttcaacgatgaaagatgaaaccagttgatagctgcattgacactgtctgaatctgcccaatttattggcggctcattatcttaataacccggcagcggtagcttagtgggtgggaggctcacttgcacggattgggcggagggaggcatcaatagccactctaaaaggactttgcaaagagaggcccctgggtggcctgatggggctgggttggactgtgttgaaggggcttacctgcccgggctgtgctgtgctgtgctgtgttggcccgactgtattggttatgggaggctgtgctgggcagttgggctgggttggctgcactggctcaggcctggcagtcttgtccctggtgtgatcctgggctcagcctggtgtgatcagcgtagtcaccaatccaagacattcattctagaagctggcatggcctccgtggccatgctgacagacttgtccattcacgtagtggagagtgattcatcagagctggtggtggcagcagtaactctgacagagtggaactgctctcaccatcctgtcacttggcctctaaaaataactcctgccggttccgagtgaccgcaccgccaggtgtctggaggtgcagtcctgtggttgtggctatgtgagggagggtgtgtttgtgtgtgtgtgtgtgtgtgtgtgtgtgtgtgtgtgtgtgtgtgttggggatagaggtgccatctgggggcctcttgattggttgacctctgagccagggctttggggtgggagtatgagaggcagaccaggctcgctcttttctaccctctcatagctggggacagagacagctagtgggggtagcagtatttttcaggactgtgtgctcactccctgctgaaaaagggcagagagagtggaatggagagggtgacttcagaggcaatatgacaagggtgaggcaggctctggggaagcacagcatttagccaatcaacatctatgtcccacaaaagcccacataaaagctcatcgtcttagtgaagtctttaatgtagggttcctttaaattagatacaaaatacaaaatacacacatatacagctaatttcttatcgtggctgattagagatcatctagcccaagtcttaaccaaggggattatctatctatcactcagggggtgatctatgcatgggcttcatgagctctcttgatacctgaaagatgataaaggtaggtatgtgtgtgtgtgagtgtgactttgtgtgtgtgtatgtgtgtgcaggtgcatacccatgtacatttttctaggagaagctctgcagttttcattgcattttcaaaggaaatcaggaccgataaaaggttttctttttctttttctttttttttcttttttcttttttttgagacagtgtctcgctctgttgcccaggctggagtgcagtggcgcgattttggctcactgcaacctctgcctcccgggttcaagtgattctcctgcctcagcctcccaagtagctgggactacaggcgcacgccaccatccctggctaatttttgtatttttagtagagatggggtttcaccatgttggccaggctagtctcaaactcctgacctcaggtgatctgcccgcctcggcctcccagagtgtaagaattacaggcgtcagccactgcgcccagccccctaaaaggtttagaactgcgctagtccaaccccctcatattacaggtaaggaaattgaattcagagaggaaaatgactgcccaagatctcacagcaaaggtcaaatcaaggtttcttgatgcccagcccagcgccctctgccacacaggacgccaccctcccctgcctggttccttgagccagggtctagctacctacagtaggcaggatcacagtaccattttccataccctcttggctggcatggatccaactgaacaggcttgaggctttcaatcacagtgggcagctgagccctcacctccagaccttcccactcccaggggaaaacccatggggcatctcctgactcattcctttagagggcatctttgcccaggacagttaaatctgtctgttgacattcttatcctggtgggacactctctgatacaggaagtgcctctgccttgtgggaaaggaactgaccctcgggtcctggaggacaggaaatagaatggctgagtgggcctgggaatattatatgatggaaaggcaggaggtcatagctagtggcaagagacagatgctgtctcattgtatatgggaggaattaaactgccataggagtgaataataggactgataagtaacatttattgaatacttactataagttagacactcttctaagatatttacatgtattagctccattaatccttataataactccatatggttattataaggaaactgaggcacaaatagattaagcacatctaggaaacaactgagccaggatatgaagtcaggtcctctgactccagagtatacatcactctggagccaaagtgtaggctcctagcctctatgctggcagacctgaaactccagtgtgcgttagaatcacaggagggctgatgaaagcactgttgctgttccaaacctcctagtttctgactcagtaggtctgtgtggggcctgaggatttgtgtacttaagagttcccagataaggctgggtgcggtggatcacgaggtcaggagttcaagaccagcctggacaagatgatgaaacccccgtctctactaaaaatacaaaaaaattagccggttgtggtggtgggtgcctgtaatcccagctacttgggaggctgaggcggagaattgcttgaacctgggaggtgaaggttgcagtgagctgagattgcgatcacaccactgcactccagcctgggcgacagagggagactccatctcaaaaaaaaaaaaaaaaaaagagttcccagatattgctggtgttccagggaccacactttagaatcatccctgtttcctgataggaagagatgaacagagggaaaagaagtggtgactgatctcacctggattattgcaatgtcccactgtggttccaggcttctccttcactccggtcactgagtcttcaccaggagcaaattaattttcctaaagcccagctctaattatgcctctgctcaaagctctctggatcctctgacactatccaccattgctgtccactagaaatgtctgtagtgatgaaatgttctacatctgcaccgtccagtatggtaaccactaaccacatgtggctatgagttttacattttgttccattaaatttaaatttaaataatcacatttggccagttgctagacagtgcagtgcacttggtttgtcattcaaggctctgcttggcaccagctcctttctatctcctcagggatagcctcaaccctcagtatcccaggctccaggtcatatgcagcgtttcctgattctaccttgtaattcccagcactatggcttgtgttatgctctctcctcagtctacattgtccttctgccctgcctttaatgcccaacccacatatgacctcttcctcgaaacctcctttgacacctgctgctctctaatctttttctcctctgaactccccaacactctgtcctcttcttacaacctttagtgctttctgttttacattgcagttggctggtgtgggtactttctcttactaaactgtgagcttttggaggatgtgactgttttctgtagagagctcttgcttcctactgtaggtccctccaggtacacagaggagttcgacaaatcccacaaacctttgtactggcacactggggatacagagatcggtaccataacttccctgtcctcaagctgctcacaggcttctacgagagtctgattcatgcccagagaaccactgaagccaatggttattttaggcagggagataaaagccacagagggcccagttggcgaggggagtccggcaggagctgcctaagcagaaggctgtgtttacatacacagacgacttctctgcccagcctggcctagtgtggggagatgggaacattcaggcgtcactgcctggctgccttgtgaagttgcggattaaccagtgatgcagcggctggtctagccgtctggtccctgcagatggatggatgaagagaggactgaaaagacagcagagcagtgccagcttctggaagtgaagtgctggctgggtggagtgggcacctgggctgggaatgtgagtgcaaggaaatgtttgtgatctgacagcagacagcaggtgaaattctgctgggtctggcttggggggttatgaggtcttcataacagtccctgttttaaatggaaaaactgttgaaaagaaaaaaaaaaaaaggaggtcaggtgcagtgggtcatgcctgttatcccagcactgtgggaggccaaggtgagtagaacacttgagctcaggagtttgagaccagcctaggcaacatggcaaaaccctatctctacaaaaaatataaaaattagcagtgcatggtggtgtacacctgtagtcccagctacttagggggctgaggtaggaggattacctcagcccggggaagttgaggctgcagtgaaccatgatcacaccactgcactccagcatgggcgacagagtgagaccctgtctcaaaacaataataacagcaacaacaaaacagaggaaaaaaagatagaaacagctttctggctttagactctaatcctaagagtattttacatcctgaaaatctctagcatatattcatctctgggacaaaaacattaaaaaaaggaaactttattgatgttataacataaacacagaaaagtgcacagatcataagtttacacatacttgtgtaactaccccccagacatgaacagaatatgtcagtatctccagaataaacctgtgtgaagcccaatgtgtgtaggattaatgatagaacaaacacaggccttggagtcaggcatgcctggggttgaatcctgggcccctgcacctactagcagtgtgaccttggatgagtgatttaacttcagtttcctcccctgtaaaatcaaggtggatctataatgtctgccttacagggaagtaggagatttaaaattgaaaatataggcaagttgctaggcacagtgccagcacataagtggggactcagatgctctctgcaatggcgatgttaattgatggtgatgctgcagcaccttctggcacctgggaccagggacacacacacagcttttctcctgttgcctctcactgctcccagcctctgtatgatactctccagctctcttctgactgcaaggaattagagatgctgtgatgatgcaaacctcagctgacacttcaggcacccgacgggaggctgggtggacatctgtatctagtgggtacatggccagatttttcatgttctggcctcaggaatgtggctcccagacctcctagaggggctgatttcccaagaagcagctggaagcatggggacctattaagaaacatagccgaggtggagataaggcagaactcagcctcaggagtgtcctggcatcctgggtggactcctgactcctacttgctccctggcctctggctttcggtgtgaagatggccaacacatactatgcacatattgtgaactgggcactgatgtgggccttcaggggtgtgtgtgggcggagggaagggagtatgatgaaaagtggccattatcctaaagctcatagtgcaatggaagtttaaaacccttggacaggtcacatgaccctgaacttgagggtggcaggacggagacagagaggccaagaggttatttctagccagaggagttggtgcaaagaggaagggttcaggaacgacttcctggagaatgcctagaagaataactatgggaaatgggaagagggtctcccaggcagagaagagggcacagccactgtgccctggggacctggaaccagtcagtttgacaaagctcatcacatggaatctgagaatgaggctgaagagccaggtgagaccaggctgtggaaggtcttgagagtcgggctgaggtatttgagttgcttcatcagagaatgaggagccactgaagcttcttccattgaggaagcagagccagaccagatcctcttactgtgctctgtggagaccagcattgtttttagccaaagatggcaatcagttgtccaagccactggagcggtctgtgagagcctctgggatgcccagacatgtacagggggcttggctgtgggtatagaagaggaagaggggcatggaccagagctgaggttcccagctttgagaaatgacagtcttactggagacgttggagagcctcatgacaacggagccccaaattcaaaagtagaggcaaggatgagatgagggtccagtaggcagagaagaagaaactggctgggggagcatgcggggcggagatggggccaggctttctggaagggaggcaaccttcagaatgggcaggctttggagacactgagggtactgaggggcaccctagtggggtccatctgaggtgcagaagggagcttggagcatgccagcaccaaacagagcctttgtgggcattcttgcatgtcattctcatagctctggaagacggtgctgatattatccccattgtacagatggggcaactgaggctcagagaggctaaggccttgctcaaggtcatgcagctcctgtgctaataaatgtcccccatccctgccccagcccctttgccagaggtgaacattgcccttaggctgttcaacaacactacactagatacgtatggaaaagtgctttgtatactgtgacctgctatgcagtttgcaggcatcctcatcattccacactagaataaggcttaacgcaggagggtgtggttcccacggtctgggctggatggaaggttacagggaagggtaaggtctctgggaactgcagtgctttgagaggcttcttagagaagatggagaagaggaagtagggggcagctggaggggggaggtccctgcaaggtgggcactgccacctgtccaccctgcctacttcctccacccagacacagctgccctgtggtgccctctgcagagtgccaacctcagtgaaacagcctgccaggcagcacttcccagaatggtgggtcatgctgctctgttaagtttggctccgctagctccctccctctggcccagctcccagtggcctggggctgtcactgggcccggctgccctcccgggcaggagccagctgccctccagctctcttgtcctggaacaccctcctccccatgacctcacctttaacccagcttggcttagtgtcttctcctccaggaagccttttctgatccctatgggctgagttaggaccccagagtatctaaacctgtactgaccaaaagaaatataatgtgagccacacgtgcaagccacacgcaattttaaattttctagtagccacattttttaaaaaagtcaaaagaaacagatgtaattattcaaatgatttgttttatttaacccaatacattcataaggtttttttgttttttttttttttgagacggagtttcgctcttgtcccccaggctggagtgcaatagcacgatctcagcttactacaacttccgcctcttgggttcaagcaattattctcctgcctcagcctctggagtagctgggattataggcacatgccaccatgcccggctaatttttgtatttttagtagagatggggttttaccatgttggccaggctggtctcgaactcctgacctcaggtaatccgcccacctcggcctcccaaagtgctgggattacaggtgtgagccatgcccgagacatattacattctttttggtatgaaatcttcaaaatctgatttttatatttacagcacatttttatttgaacgagccacatttcaagtgctccatagcaactagccatggctagtagctaccatattggttagcacagacctaaaaacagggagtttataagggttgaagctcagagtttggcaccagacatacctgtcagtcatattccgaccctgccatttattagctggatgaactttggggtcgctaacccttctgagcctcagttacttcagctgtgaaagggattaataatttcagtgccagagaattgctttgaggattaaacaaatgaatgtgtgtccagtgccaggcacagaggaagtgctcagaaaatggtggtgcttcaccttctagtatcctctgatgtgctggggtacgtgcctccactagattgattgtgaattcaagggcagaggctgtattcaattcctccagccttccccagtgtccagggcctggcttggtgtgagcattactgcttgctgaatgaaagattaagtccttgggctgggagtgctccccaccccaccctgcttgcccagtagtcaagggccctggtggctgggagtcaggagaccactgactacttgtgggtgaccttggcaagtcactgctttgcttagaaccttggtttcctcctttgaaagataaaagggagataggaggggccctgcctgaagtgtttggttgaatctctgccccgcagtgaccttgggggtctgtggctgactctgtgtcccttgctttcccagccagtggagcgaatcacttccgttctcctcctggctttcctgtatcctggacttttgcaccattaagttccatccagttaaaatttaagaggaaagaatttctcctgcctcctagacagagcagagagggaatgaagggtcctgtcccttctcttctgccagcatctgctgacctcccatcacagcagcccagtgacagacatggggcagggattctcccattttataggtgagaaaattgaggctcagagatgtcaaataacctgcctaagtaatacaaaaagaaatggtagcgctagggctggaagcagaatttgcagctaaggaactgaggaaccccttttttggatgggctcctctttccttctttctccatgagacttggtcctaggttgagtcctatccctgtgcctcagtttccctgcctggggaatgaaaacagtcaagtaactcaagtagtaattgcaactgatgcctatgggggccatacattcttaagtgtctctcctgcttcctccagcctgatttttctggaaagggttattgttgggtaaagtggaaagtatgtagtccagggagccagtgtaactgtgtaagcgtaaccttgggcaagtcactcccactctgagcctcagcctgcctatttataagatgggggccgggcgcggtggctcacgcctgtaatcccagcactttgggaggccgaggcgggcggatcacgaggtcaggagatcgagaccatcctggctaacatggtgaaaccccatctctactaaaaatgcaaaaaaaaattagctgggcatggtggtggcaggcgcctgtagtcccagctactcgggaggctgaggcaggagaatggcgtgaacccgagaggcggagcttgcagtgagccgagatcgcgccactgcactccagcctgggcaacagagcgagactccgtctcaaaaaagaaaaaaaaaaagatgagggatgatattatctcacaagatgctgtgcagatgacacacaaaagtattttgcaaactggaaagtgctaatagaaatgttagtgaataataataataatcaaaataattaaaatagcagaagcctcattttctgtgtggtctcaatgacctgaagtgaattgagccctttgggtataaatgcagaacgatgtctgggaacatcctgcctcggtctttggagtgtagcctggattctcctgggaaagtgagaggctccatctggttgaggagggtgggaaagtggccctgccccaggggaggagtggggagggcttcagcctgggggaaggaaggaaagggagatggccagggaaggagagttgaactaagaggaacagagagagccttggccatgcagcccagagcctcctgcccacgggagcccacgattgggaaggctcagccagcaggggagactgagcctatttggaatcaaaatacttgaaggcaggcagtcaagaatctcttagcagctgtgcatctgaaacaataaatgcatctggtataactcctgagttttattggtcctttcactcattcatttaaataaatgtgtggtgagctaaactcaaacagagcaccttgtgtggcaaagtgacttgcccaaggccacggccccaggggcctgtgtgagactcccttgggagctcctgggaaaaagtgaatttgaaaggcctggggatgagaagtccaaaggcaaaggacaggatttgtacagaaggctgccaagcaggacactcgtccttctgtcagtcggcctgggcagatttgtctgtcttcccaccttctgtctggagggtgggcctgttctctaggactgggagaagctggcttcattctgctctctgctcttcatccgctgctgaacctggtgagcagggggagtgaaggcaccggaagctttgtctaaagacacctgatgaaggaggtttaagttggagaagagaaggcttgctttgggcatggtacaaagggacgcaattgtatcttgagttctctaaagggtgctgaggagagggcatagcctcattctttggaggccctagagtgcctatgaggacccagggtagaaggtcaccatgatggagcagcacactgggagggaggagttgggggagggaggtgcctggctctatagtgtgtgacaagcagagatggagagcccactggtgaggctgatactgagggaatcgcatcagggaaggatggagggctcagctcacatcgaggctgcttcccagcttggggcctctgtgcttcccagggcagtggattctgtggtaagaactatggccagcacatggtaggtacttaggaatgatgtgaagaatgaatgaatagttgtgtatgcctggaggtgagggtggtgactgggggttcgcggtcatatgggttgcagtggacccatggacagaaatctttggagatcatgctgcggttacccaccattctctctatgccttcgccatgaactagggaccctagagataggaacgtccagccctttcgtcatttgcaaatgaggcccagagcatggaacaacttgcccaagggtacttgctgagccagtggcagacctggactggaacccaggccctctccctcccagagtcctctgtggcttgaggtccccaccttcggattgtgtgagatggaggtgctgcagtggttggactggtttttttagtgggtaacagtgctcctggaggggaggagcatggcttaccttggttttgagccatgatctctgccacaagctgcttggccagcccctgccctttcctggagctcaggtgcacactcagcctgtgctcagacacatacagcaagtgcgcctgtacacaggccccatccccaataggtccctgggctctcactgttacacttactgtcattgtcaccaaggcgcatgtggacaaatgtacacatagacaccctctggacacactcagaggcacagaggattcccaggagacagttgtaatacctcctcccggtgggggaggacgccgagtcctaggcgggttctgccctgtcgctgtgctgcaggggtggtgaggggatccggctccggtgggatgggaggcccactgaggctgagtcaccccttctgagtcaggcatgcatccccctcttctctcctccccctccctttctcgctgatgagcccccaagagggcttggcgagagcaaggaggcccggggctggctaggaccagggtgggggcagccggggcgctcgagaggccccccagctgcacagtcccgcagtggtctgggaactgcccgtgtggcacggaccgggaggaggtggcctgggagcctgagagagagggcggggcgcggggggaggtgggtggtagaggagacaggcagagaggaggcggaggcaggggcagggccgcggcgcgctgggaggcaggcgcaagcggcggccgcccctgggctgggctccgaggccggggcgggggcgggggctggccgcgcgtcgggcgccaggcccggggctgtgggcaccgtgcccagcccctggcgcacgccgagccgccgccgccgccgccgctgctgcagtcggcatccatcagcgggcgggggtgtcgccgaacaggctgctccgcagagcccgccgcgaccccgcgccgccccgccccgcggcctgcctgccagaggagccgagggggccgcccctcgcccaacctgcccgacatggggaaccccgggcccaggtaggcacatgggggaatcaggtggctctcggggccgggggcttgcaacatctaggcccagcctccagccctggggaggaacgggggcgaggccgagaactgagttttcaggctgttggtcccctggccagtgtgggggagggtctcgctgttcctccctacctaccggtctgcagcctcctccaaggcctggagagaggatccggaggctgggggttggcggggggttggtcctgctgtaggatgagcggtgggtgggcgctgggctcccaccggctggcccagtctcttttcggagagcactcctgctgccgcctccagaggccaagggctctttggatttctgctgcttctgacgctgcaggaggagttcttggctggagcctgggatgctggcgagcccttgccctcatctctcctcactctggttacggacccttccccgctctgggcttgcctccccttccgtctcccttccaagtacctcagagctgctaggagggatcttagccctaggacttctgcagttctggcctggcattgtcctggccagtgaccgtcccctgatcagagggagagggcttgtgtgtcccacttgtgtctggcaccttcacacttggggaggtccaagggcccgagaggctggggtctcagggatgggcatggggggccaatgtctacagccattggggtacttactgggtgcagaggccactgactggcagacgtatatggctcaaagtggtccatggagaccttgaagtctggacaaggaccaaaagggagttctggggatgctggtctctccctcagctgccagccatcgtcgttgcttttccctcggagctctgaggatgcattggtgggggagagagcaccacgtgttcccacattcacttctggatccgcatagcacctcctctgcacccaaaggtgggaatgtgagacggccagatttaggacctctccagggctgtgcggggtccagcggcttggcttcattcccaccccatccccccaccctcagcattaggagccttccagaatcagtggcacttgagccaggtcaagatctggggcctggatggtgccctccgcagctcttggaagacagtgcctcctgtcccgggcaagggtgtggagaatagaggcagctgtgtgcctctctgcccacccattcctccagatggagcctgcggcagaggcagcctgtgccagcctcccctatgagccaccgtggcccaggaaggctctgccagctctgtgcaaggatggagctggcttctcctggccagcctgaggtcatgcctgcctggcaacccaggcatagtatttatggcatgcagagcacagtccctgggatttcaggggcacctcaaggcagtcctggaggagatcagtgcagagggcattgttcctattaaagcccttcctgggctatgtgacagtcctcctgggctcagccctgtgagcttcttgaagagcttcttccatagaatcctgcatgaaaacaatgcttggtcaggtagtcctcactcagtcgatattgaaaggttgaacggggcctagagagtaagagtgacttggccaaggtcacaaagcagctgagcgggggagtcagcattaatgtacccaggtcttccacctcttgttctggggctcttgcagctcaggtgctggcttccctgctgcggtggttgtgctatagacaggactctgccaagggctaggcattgtagcctggagcctgaggctacctgatcccttaggaggggtgttatgttggcctcccagcccttgccctcagtaggtgagcaggagaggtcagggctgagagaaagggccgtgggtggtcctggaccctcttggaagtgcatagagctgagaggatgccaggtgcccagggatgttctggcctgagcctccagggggcaacagagagttttctgacttcaggctgtggtgggaggtgcttgttagcacctgccgggacttccctaagagcccctttctgggcttctctgtcccatttgttaaaaggggacacaggcgtgcgccattgcgcacgcctgtaatcccagcactttgggaggacgaggcgggcagatcacaagttcaagagatgaagaccatcctggccaacatggtgaaaccccgtctctactaaaaatacaaaaattagctgggcgtggtagtgcacgcctatagccccagcaactcgggaggctgaggcaggagaatcgcctgaccccaggaggcagaggttgcagtgagccgacatcgtgccactgcactccagcctggagacagagcgagactccctctcaaagaaaaaaaaagggcggggaggatgatcatctctgcctggagataaataccaatgattacacaatcaaagtgatagtatttattgaaacttactgtatgccatgtactgcaagaagtgctttgagtcatttcacagtaaccctgtcagatagatgtgattaattatccactttttacagaggagaaactgaggctcagagaggttatgtcactggactaaagttacgcagctggaaagtgcgaggcggtctgagtccagagcccttctttctaccatgacatttactgggggcaatatctggaagtaccaggttggtgtccagtggagccaggcaattcattggtaggccagggccagtccaggtggagaggtgtgtgaggggtgtgtgtgtgtgtgcctggtgaggcaagggtggctttgtggactgaatattactatagtgctgaggggtaggggtagataagtactgactaggagctctcagagaaggattagccttggccttctccttcctggccagggtcccccagaagtggggaaacaccagactccctgctcccattggcttttagggaagatgggctggctctggacacatcccgaggccacagtggggactgggctaaggaggccctgtgggcagggagctgagccttggtggatgggtgggggtggagcaggctggcactgcttcctttgtgggctagaggcttgtggatcagaatagtaacagctaacatttattgagcatttattatgtgccaggcccagttttaagggcttccatgtacaactcatacgttcttcacaaagccctgtgaggtgtagatgaggtataggagttattcttcccgttttacagattgatggagctgtggcttagatagttgttcaaggtcaaatagctaggctgtgggggagtcaggattcaaacctaggcagtgtgggtcagagccatgttcctgaaggccatgccaggcagcctgtagtttctcagaggccatactctgttttgttcaagttgaaatagtcactcagtcagatgcatccctctcctcaaaggcctcccagtctagctgggagagatgcagacatgacacactaaaagtaaagagtgtgctattgcataggctcagcatggattcctattttggtgctcagggaaggcttcaagaagacggggacctttgagctgggcactgaaggccaagtcggatttcgatggttgaagggggaagggcacccacttccccaggtcagaggggaaggaaataggaatgcctctgaagaagagtgggcggtctgatgtgcgtggaacagatagtgtgtgtggcggagtgtgagctgggaggtgactcagaaagtcacctagtgtttgggtttttgatggagctctggaatccaccagacgtaggctatagtcacagcaatgcattgtattagccacgtggccttgggcacatcactcagctggcccaaacctcagtttcctcattcgtaaaatgcagataaacatgcctgtctcacagggaccatgttgtggttgttatataaagcacctagtgtaatgctaacacattgcaggaactcagtaaacattacttctctcccgcttctgtctctcttaaatgtcaggccaaggtgtttcgacttgacgtgagccgggatgctctaggaatctttgcaggattttagtctgctgaggagcatgacagaactgtgttttgggaaggtccttttggcaaccgtatgatccacaggagagggtggacgtgatcttacaggagaaaccttaactgtggggacttggagggctggggagggatcaagattggcactcattaaggtgtccctctggtagtgggtggttcgccaggttggagaaggaggagcttggagtgggtaaggccacagggtcaggaattctgtttcaggcctggtgagtttgagaagggctggtctccctttagtcatctggaagattgggtagcatcttttttgcacatctggcctgtttttcctttgaattatttcttttgaataaatccccatcagagcttcctctataatagcagtaaattgggactaagtgtccaacaataggaagatgattgggaaagctttggaacatccactggataaaataatacgcagtggtgaacacccacagaaaaactgcttgcagtggatggagctgtgcaattgcaaagctcttttgcatccttgattcattttgtgcttatgactgctctgcgacagaggtggggccggggctagatcctttctgtgtttgaagagaatgacgctagactccagtctccttgaaggcagagttgagttcacattttattcattgtttcgtcgcagcatgttgctcagtggtttgcaaatacttgtccgatgaaagaatgagtgaactaatcaagaggggaagtgacttgatcaaggtcactcaagttgtaagacatagtgcctgccatattcttgctattccctacttgccacattcttctcactaaccactcactatcttcgaggggaataggacagagaggttcccagtgaggacctggcacttgcatagaacagggtttaagtcttctttctgtttttactagctgtgaggcaattggcaagttaattaatctttcaaagccccagtttgcccagctgtaatgtggatagtccaagtacctggttttagggttgtcatcaagattgaataagttaaggcatgtaaacatcttggcatggtaactagtacatagtgaagtatccatgaacattagtggagatgatgatgatgtcatgatgtgatgtcattaatggtctgatacaattaatgttaaatgggaaagaagacccataagattatcagtattcatattacaatggtataaaattaggtatgaacatagatacagattggaagaaaacaggtagaaaatggagttccagcaagcatatgggaagtgaataaaacagaaaaacaaatatttctttactgttatatttacttttctttagttttaattacaaaaaaaatttgtggaaaatctaataattcagaagtgtaggccaggcacggtggctcatgcctataatcccagcactctgggaggctgaggcgggtagatcacctgaggtcaggagttcaagaccagcctggccaacatggtgaaaccccatttctactaaaaatacaaaaagttagccgggcatggtggctggcgcctgtaatcccagctactcaggaggctgaggcaagagaatctcttgcacccggaaggcagaggttgtggggcagtgagccgagattgcgccattgcactccagcctgggtgacagagcgagactccgtcacaaaaaaaaaaaagaaagaaagaaagaaaaaaagtgtattctccccttagatccccaaacaaatcctactctccagtcgtagctaataacagcatgttgtgtatccttccaggatattttctataccaacataaacatacaaaccagaatgggatcatacattgcattattgttttacaacttgcatttttcatgtaactacacattgacatctttttatgtcagtagatataaaatctatctcaaaaatttttgcaataggtatgttatactttcataattaaatttttaatggataaaccctactaatttggccagcccccctgttgattgacatttgaagttgtttccaattttacggtattctaagtaacgctaactgaactctaacagtatttagacaattagtgaaaatcaagtgagagaaggagtcagaaaccatgagaccgtgagagttgccctcaaaggtctgctgcttctcccttctcctgttccctcctctcctcactggagcctgggggaactggtcttggaggaggccatctctctgtcaccctcaaaaggtggtgatgtcccagggaaagaccctttctttcacccacccagtatggagctctcctaggaaattttcaaattctcttaggatgctctaagctgctgcttgggctgtgcagctgcccacacccagactgtccttggacaagctttctaccttctctgtacctcagtttgtccatctgtctggtggtgatcagagccattgctgccactgagtgtcttctatatgtcaaatactgtgctagagcaagcttcatgtgcattatctgtttttctattttttctttttattttattcttcttatttttttgtttgtttgttttttgggtttttttgttttgtttttgagatggagtcttgctgtgttgcccaggctggagtgcagtggcaggatctcagctcactgcaacctccgcctccccggttcaagcaattctcctgccttggcctcccaagtagctgggattacaggcacgtgccacctgcctggctagttcttgtatttttagtagagacaggttatcactgtgttggccaggctggtctcgaactcctgacctcaggtgatctgcctgcctcagcctcccaaagtgctgggattacaggcccagtcgttattcttgtttttttaaagacagcctgtcactctgtcacccaggctggagtgcagtggcatagtcacagctcactgtgacctcaaactcccaggctctagtgatcctcctgcctcagcctcctgagtagctgggactacaggtgcaccccaccatgcccggctaatttggggggggcacagggtaaagacagtgtctcgctctgttgcccagactgctctcaaactcctgggctcaagcaatcctccctccttggccttccaaagtgctgagattacaggcgtgagccaccacaccctgcctatctcatttaattctcactatacaccttggaggtgcaggggatagtcttctcaatagaggttaagtaacctgcccaaggtcaccaagcctgtggcatcaggattccagctctggctcataagcccatgtctgtaactgctgtttcctgcccactctcaacagtggctaattggtgaggtccaagcaaaatgattataaaaagatcctttaagttgtaaagtgccctgcatgtgggagggattgatactgccgttattatttctacatccagagcaacagtagctttggttatatggcttacagcaagttggaggtcgtgggatgtagcagcattgagtggggagagcactggactgtgagccagcagacttgagtcctagtcctggctctccttgaaactgactagccatgtggccttggccactaagccgcctgggaaataagctcacctactccgtgtggcccttgtgcagctcaaataagataaagcccaaaagacagccagcatgttgcccagctctcggaggataccctgctaacgggaggtctctctctgccttctgcatcgtcatcaggatgggccaggtgggacgcatgtctccgttttaatgctgttactctgcagttctgtgctgtcacgtggtccccagcccaccactgcacatcagcctgaggctccctagtggcccgtgaagcttttgggcaagaagccaaggctgatgggtggtggccttttcacattgtttggtctaaagtggtgtccgtgggtactgcaaacctctgacgaattgccgtctccccactgccatgtacaaatccaagcaccagacaggatgactgcagactcagctccctttttgatccttcttgcctggctgtgaaagtggcttgaggtctcagaggcagctctctcagcctgtaccctccatcctttcattcacgtccatgtagacattatcactcagggaagtgagtgttccatactggggaagtccccttgggaaggaagtcacatcatctccagcaagtgagagaaagaataagccctaataggcactctttctgtttttttttttttttcttgtaattcttcttttttcttttctgactccgaaagtaatacatgctcatagtagaaaattgaaaaatacggagaaaaaggcccctatttccttctccaagggaaggctattgttaacattttagtctttggacttaattggagagtaatatttctggagcaaatatttctaatattctggtatgtgtttagtgttttacaggcatgatctgattccattttcacagtaagcctgtgaggtatgtaagtttatcatcatgactttacagatgaagaaactgaggcacaaagaggttaaggggcttcctgacggttcccttgccttccttgacttcttagcttattctgcctcttctcaggctccccttatcctaagtgagcatcaggtggtggatcagtcagattctgacaggaaacagaattccactcagatgcttcacctgaggagatgttaataaagatgtgagcagggtgaggggaacccacatgggatggtgaggcacccacaaactaacagtgacagaaggcattactagctctcggcctgaatgagcaggagggagtggtgttacctgagttccgtgactggtagaggtgggcagggagctgtcgcagaggggctcagccaccaccaggaccacagagagagaaattggggaagatacacccaggatctctctccttccaccttctgaattcctgccagtgccttcttctttattattttttttttaagacagagtctctgtcgtccaggctagagtgcagtagcatgatcttggctcactgcaacttccacctcccaggtctgcctcagcctccctagtagctgggactacaggcgcctgccaccacacccagttaatttttatatttttagtagagacagggtttcaccttgttggccaggctggtctcaaactcctgaccccaagtcatccacccaccttggcctcccaaaatgctgggattgcaggcgtgagccactgtgcccggcccctgccagtgtcttctattggccaaatggaaccagaaaccaggaggcaagggagctcaagggacagtccaatgggccagcctcctgcttcttcaagcaggtcatggatctgggggtgcacatggagactaacaacccaagcgacatggttgtagggagatgggagagacatgtcctctgacttcccagaaagagttgtcttagtaactgactattaaaaacatcattcaaaacaagagactttttttctgcctgggagtctcttggtgttttggtgtctcctccctcccctgccccccatctcctctctcacctggttcagaatttccaagaacacctgggcaacagtctttggtgtcatcggtgtgcagggtttagaagagacaaccttgcttgcatgatacatgtggctgtgtgtgttctcatgttgtttcactgctgtgcctatgcatacaaagacatgcttcttgtgtacatgtcataagcatctataacatagtctcctctgtatccagcagaatattcactttttatttatttatttatctaattttatttttttgagatggagtcttgctctgtctccaggctggagttcagtggcatgatctcggctcatttcaacctctgctgccgaggttcaagcaattctcctgtctcaggctcccgagtagctgggactacaggagcctgccaccatgcccggctaatttttgtatttttagtagagatagggtttcacgatattggttaggctggtctcgaactcctgacctcaggtgatccacccgcctcaccctcccaaaatgctgggattacaggtgtgagccactgcgcctggctatttatttatttttgagacagaatctcgttctgtcacccaggctggagtgcagtggtgcgatctgagctcactacaacctctgcctcccagtttcaagcaattcttctgcctcagcctcccaggtagctgggattacaggcacgcaccaccacacttggctaatttttgtattttttctaggaacaaagtttcaccatgttggctgggttggtcttgaactcctggcctcaagtgatttgcctgcctcggcctcccaaagtgctgggattacaggcatgagccaccgcgcctggcccaggacattaacttttgtatctcaaagtcctcccattctctgtaatagccttgatctccatggccttcctctgatgtggacagggtctctcatccctgtttgacacatgaggaaacatgctcagaaagaggaagtggctgggtgtggtggctcacgcctgtaatcccagcactttggggggccaaggtgggtggatcacctgaggtcaggagttcaagaccagcctggccaacatggtgaaaccctgtctctactaaaaatacaaaaattagctgggcatggtggcatgcacctgtaatcttagctactcgggaggctgaggcaggagaattgcttgaaccagggaggcagaggttgcagtgagccaagattgtgccactgcactccagcctgggcgacagagcgagaatccatctcaaaaaagaagaaagaaagaggaagtgacctgcccaaagctgatcagatcggaagtggaagcactgaagcagcagtggtcccagttctgagttcagctcttcccagtatatttccttttcaatcttgggaagtctttctttagccagccccaaccctgggagaaatcagtacagcatgagccccctgaggttgctggaatgccatacagtgggaagaactctggagtcagagatacctggcacagccttatgactttggacaaatccatttgcctctttgcacgtgtgcatcctcattagtaaaatgaggagaataatatcaggactttggatggaaacatcaggtgttgagataaaataaatcatcaggagaggcaggctggctggtagccacaaaggctcccaaggtgaatgcagcccaggtctccatcctcagttgggtagactagaaattgtctctttgtgttctatccatcagttatccatgtgttcaaccttttatccatctacccctccatctgatgccaaatctgctgaatgtgaattctggcactgctgtttactagctgtgtgacctggagcaagttccttaacttttctgcttcagtttcttcttttgtaaaatagggataataagagtacctattacccattataggttattgtgaagatgaagtgagttcattgatgtaaagtactcagatcagcgcctagcaaatagcagactacaaatgataatgttgtttttatttatcaagaactgcgctgagccctggggataatggctaaccagacaaaattcttatctttatggagtttattttggaaggagggataaaaagaaataagtaaatcaatcaatgatagaagatcagtttgtgataattactgtgaaaaccgaccacccagctgggcgtggtgactcacacctgtaatcctagcactttgggaggccaaggcgagcagattggctgagcccaagaattcgaaacccaatctctactaaaatacaaaataattagctgggcgtggctgtgtgcacctgtagtcccacctactggggaggccaaggcaggagaattgcttgaacctgggaggtggaggttgcagtgagctgagatcatgccactgcactccagtctgggcaacagaacgagactgtctccaaaaaaaaagaaagagaaaaccaaccacccaacccagcatgcttgcttaatggattcgaagtttctgtttggggtgataagaatttttggaaatagatagtggtgatttttgcacaacattgtgaatgtaattaatgcctctgaattgttacccttaacaatggttaacaatggcaaaatgaaacaaaaacaaaacaatctagcatgctgtaaccaaaaaaacaggggaaaggacctaaataaattagacagggtggtcaaggggcacacagattcacaatctgaaggtgggagctgccaagctgtccatgcagagggaacattacagactatcattaaggacaaagccccaaagcctcgcacagtcgaagaacagacggaaagccaatgtgacaggctcatggtgatggtggcggcttggggagggaataggggaccagtagtggtgggagctgatgctgaatagatgggcaacagccatatacagaggtctgtagctttgataaagagtttgtgttttattttaatgggaggcccttgggggttttaaagagggcatctggctgggtgcagtgggtcacacctgtaatcccagcactttaggaggctgaggcgggcggattgcctgagctcaggagttcaagaccaccctgggcaacatggtgaaacccccatctctactaaaaatacaaaaattagctgggcatggtggcgggtgcctgtagtctcagctacttgggaggctgaggcaggagaattgcttgaatccaggaggtggaggttacagtgagccgaaatcatgccactgcactccagcctgggccatggagtgagactccatctccaataatattaataataataataataacaataataataaataataaataaagagggtgtccattgagagttttggaaagattcttatggctgctttgtggataataaactctaggagggcccaagtggtcacagggagaccatggagcaggctggggcagcccctggaacaagctgatagtggcttagatttaggcagttgcaatggtgatggagaaaagaagcaaatccaagttactggactcagagatgctgactcatgctaaccctggttagagggcctgatgtataaaccggacaccagttgattcattttttaaggagtggtttcactgccaggctgagtggatattgcctcatctgggctaggacaccctctccctgcaggccacccagataaacagccacaggtgagaaggctgctgagtgcccctggaaggtgagctagaggagccagaaggtggttagggtgttgaagagggtcagatgctgacagtgtgctgggccagccccagcccaggcaagcatccctggcctcactgggtccctttcccccagacagagtaagtacaggcgctgtcagcatttacttctctggctgacctttctcttttctaatcctgtgcattaggcctttcatatgttagtgtcatcagtctggccctgctggcctctgtctgttagaaacatctctttttccatttgttgtgggtggacacttctgaagtcccgttctcaggcccctcctcactgcagcttcccattactgctggtaattatagaccctacgtctcaggcttgttttattgggtgtataccatgttaagtgcttttttttttttttagatggagtcttcctctgttgacaggctggggtgcagtggcgcgatctcggctcactgcaacctccgactcccagttcaagccattctcctgcctcagcctcctgagtagctgggattacagcctcccgagtagctgggattacaggcacgtgccaccacgcccagctaatttttgtgtttttagtagagacagggtttcaccatgttggccaggatggtctccacctcctgaccttgtgatctgcccacctcagcctcctaaagtgctggtattacaggcgtgagccgccacactgggccactaagggctttctctgtgttattttcctaaatctccttcaccatcctgagagggagggaggagtgtctctgttttattaaacaggcaactcaaggccaggcatggtggctcacgcctgtaatcctagcactttgggaggccaaggcgggtggatcacaaagtcaggagttcgagaccaacctggccaagatggtgaaaccccgtctgtactaaaaatagaaaaattagctggctgcggtggcggtcacctgtaatcccagttactcgggaggctgaggtaggagaaattgcttgaacccaggaggcagaggttgcagtgagctgagatcgctacactctagtctgggtgacagagcaagactctgtctcaaaaaaaaaaaaaaaaaagtggcaactccggctcagaaaagtgaagtcacttgtccaaggtcacagagtgagcaagcattggcactaggctttggatctgggtctgcctgactccacagcctgtgctgtgaagcactgagccacagggccgcctgctctacctcccttcaagaggtccatgaatgactgtgtgaagtctctagccctgggcctggctggcagcaacgcttagtgttgggatctctgtccttctcctgcacagtgatgcttctgactcccagcaaggctcccagctccgtcactcctcccaagctccaaccagttcctccttccaggctgtttggtgctcacctttacaggcttctcactctgaagtgccagaatgtcaaggtctcctctctatcccctgcccaacccccttcttcccatctctgggcatttgcccacatggtgactcagctcaaatgctctccctgcatctcctgtctaaatggctcccttttttcaacacctaattccaccttcacctccccaccctagaagcttcctttgggaactctaggctatagtccagatcaccaggtccccagactctgctgagaggctgaaacatacatggcaaatctaaatcatctcctgcatgagtgtttagccatttcctgggtgagcatcctcttcccacactgcagccagctcctcgggaaccagcacgtgcttccctccaggggccactacagtgcctggcccagcctagccgcacagcaggctccatcagtctgtgctcacctgggcctgggcagaaccatgcccacgtgacgggctatgtcagaagccacggccacctaggctccctttctgtggcctagtgagagaaccatgctgttatccttggatttgtgaaataaagatttcatcatagatttttttttttaaagatgttatttttgatttataaatttttaaaaggtttaaacagattttatctccttctcatactgccataccaagccatgtgcctcagaaaaatttcttttttgacctctaacttaaactcattcaaggaatctccaagtatagtagcaaaaccaagaactacagttaaacagaagaaaaaataataatctgtcttcccgccacccagaaataactatagttaatactttgctgagttttctgtatctgtgcatgtgtattcattaacacagagataatctgtacaaactattgtgtatcatgctttttttactcaaatcttttccatgattttttacgtttttttccttaactctttagagtggataagccatcatttctctcactagcccctggccatggaatgcagaggtggctcctgccacgtccttggtgtctagcgtgaacctgagtactttctcctttggggggttctgttggggtttgcttgaggcagccaagtacagtggagagaaggcagacctagagttaggatctggggagtctggaggctggggagggaggagagtgggcggaggaaccagggaaacctggtttctgaggaaatgactgtcagtcgtcttttttgctcactgggtctcacctgtaaaggaagaggagtagattgaattatctcaaaaatgatctcaaaaggcatccagctcctctcctctgtcgttctgggagcgccaggcatttgctgccagcgggctctgctggagacccaggcagaggaagactgggatatttatttaaggttgctttcctggctatttcaaggaacctcaggcccaggaaaagttccgagagtgtgagctgaaatcagattgaggccatcggagagggaggagtggaagtgtctcccggctgtctgggcccacaaggggtcatgtggattctgcatctcacagcagaaaacacacagatgagtctgtgatgctttttttttttttctttttaagcaaaattaagtaggcagttattttaagggttcttgcctataggccttatctggcattatgaccagtatccttaagtgcaggctcagaaaagatcctgagcccggtgcaccggtatcatttggacccttccaaggctgtgggctcccctagagcagctctcattgctttgtatcctggcctggagtcagcactcattgtcctgtaagtgacagagagcctttatttaactatggctttacgttatacccataaagcagagagtagtggcttgagtggaaagcatttctgggtggggaggaggtgatggggacccaggccttcccttcctcctcatcttccttctaaatagcagcatcagtaacaacaaaccctctcatttgtactccaagcctccacgcaaaaagcctttccaccgttatccactctgtggggggctgaggatgttcagggccccagagctctcctgtgcctgagtgggatgctcagggtccctggctttctatccagtgctcttggctttgggctgggctgatgtccactgagatgcagggagaaaaactgaaaaatgaaaaggaagtgtggggcgggggacctggagcacgtggctagcccagggtggatgctgtgtctgtctgtctgtctatcagaggcctcccacgatggatggtgcaggggagagggcgtgccatgccagtctagcctgaatctctctcatgtaatatgatagatttagaggaagggcctggactcaggggtgagggttcctgctcatttctctatttccctggttttagcttcaaagcttttttttgaggatctgttgattgggggcaggaatgggtgcatctgatgcccctccgccaccctacctttctaaaaagccaacttgtacgtttaaaaaagtacgtatgtatattttatttatttattttaatttaattttatttttttgagatggagtctcactcttatcacccaggctggagtgcagtggctcagtgaaacctctgcctcctgggttcaagcgattctcctgcttcagcctccccagtagctgggattacaggcatgcatcaccacatccagctaatttttgtatttttagtagagacggggtttcaccatgttggccaggctagtctcgaactcctgacctcaggtgatctgcctgcctcggcctcccaaaatgctgggattataggcatgagccactgctcccggcttatgtatgcatattttaaaagataaaagtacttccaaaacatataaagtgaaaagtgaagttttctctcttatgtcacccagttcccagggatctctttcattttcctttacccacttctgccttaccaacctctcttaacattggtaagtatcctttcagaccttttactaaatgtgtgcaaacacaaacatatgttgttgaggttactgttttgtttttcttttttctttttcttttggagaaggagtctcacactgttgcccaggctagagtgcagtggtgcaatctcagcttactgcaacctccgcctcccaggttcaagcgattctcctgcctcagcctcctgagtagctgggattacagaagtgcgccaccacacctggctaatttttgtatttttagtagagacggggtttcaccatgttggccaggttgtcttgaactgccgaacttaggtgatccgccctccctggcctcccaaagtgctgagattacaagcatgagccaccgcgcctggcgtgttttgtttttcaaatataaaaatgagaccatgccattctctctctctctttctctctctgtaacttgcctattccagcagaatagctgggcaatgggtccttgactctctgaaatctcctcatttactgctgaaaggggaaaatgacaagaatagtttatcccagaaagcatttctctacgttgctcatgttttggatgagtctgagagaggtgaagtgactgccacatttgtggccaactcggggactgagcctgttcttttgacttttacatcgtcaagcctgcgcgtttttttgttttgttttgtttcaagtttcttcctgtcattctctttttggatctattctgtgaagttagcagggcaggaattattgaagcttggggtatgaagaggtgtgtccagcttcagcactggaaaggtctggaacccagggttcttttagttaaattctgtgcatccagctttgctgagggtctaccaagcgccaggtgaggtggctggagagacagcctggcttggaccctgcctggaggcggccactggcagccccgtgtgctcctggtagagcagggctccctggaaggactcatcatccctatgaaaggcccagagatttgagtccctgaagagctgcagacacagggtgggaggggtgcctgtgacttcagccactaacccctcacctcccatgaccctccctcctccccacttcctctgtctctcccttcctcctccctttgccctgtgactctttgtccgtttgcctccatctgtctctctccgcgtgtggttcctgcccctctcgctgtcataccattgctgtccctccctgtcacatgatctccttcatgccaatgcaggcgtgctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacaggtgtgtgcccgagagcatgggcgtacctttcctgcccagaccgtcctccaggtccagttcttagggctccagtattttttctggagggaggaaagaaggaaactaagatttattagtgacctgttacatgccaagcactgtgctgggagcattgttgttattttattttcttttttgagacagatctcactctgttgcccaggctggagtgcagcctcaatctcccaggctcaagcaatcctcccgcctcagcctcctgagtagcagggacaacaggcgtgcaccaccgcacctggctaattgttttaactttcttttttttttttaattgagttggagtctcgccctgtcacccaggctggagtgcagtggtgccactgcactcttcgctcactgtgacctctgccgcccgggttcaagcaattctcctgcctcagcctccttagtaactgggattacaggcatgcaccaccacgcctagctaatttatatatttttagtaaagacagagtctcaccatattggccaggctggtctcaaactcctgagctcaggtgatccacctgccttggactcccaaagtgctgggattacaggtgtgagccaccatgcctggccttttttttttttttttaactttcagtagagatgaggtcttgctatgctgcctagactggtctcaaactcctgggctcgagtgatcctcccaccttggcctcccaaagtgctgggattacaggtgtgagccaccatgcttggcccattgtggtcattttaaaattttattctctcagactaaagagggtagctactaactcccccattttacacctggggaaactgagcaccagcaggataaaatgagttatccaaagtcacattgccataaagtaacagaggtgaagacaaatctagatctgattttgaaggctgagttctttccatttattttcctacccctgaacctgtctgttctagcttggccagccccatgtaaccccagagcaaaacccattgccctaaagctacaacagactcacctcctcatctaattaacaccttccttaattcacgacaggcctggagggggcagggacttggccaagatcactgagggcatcagcagtggagttaggacccggggcgggcggcggtggggcaggtctctggcctttctcctctcctttaactcagtccacagctcccagactcctgctagatccagtgacagacaaaaagaaggagaccagatggatgctgtgatgagtcatgtgctgctctggggagacagggcagctctggccactggctttggtttcatgggatgctcctgcctcagaggatgcctatggcagcagtagcctgcagggaagatggggacccctcacacaaggccacccattatgcatggaagccctggctctcctcctgtacacaccagccatggaccctagttgccctgtgggtctcagacggtagcgactttcattctggggtctgtcttggccccagatgcctctatattgcttcttacttatatgaaaggccatggcttaaaactcactgagcaaactattcccttgcttggtcctgcagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggaggtaggggagcactgagtgccatatgtcccgtccccggtcagccagcctcaggtccagggcaggctcctgtgtgtacccagcttgggccaaaccagaggagtcctggaccagtcacagtgtccagagagatgacctggctcggagctcctttgtacagatggtggcaccaaagcctggagagagtggttatgattgcaaatagaattagacgaggtacagggctggcaccaggggaagattttgcagggtgactataccttggcaaggatgccaccatgtaagggctgatctacaaacagtagacctgggaactgggctcccctattcacccaggagagactgacatttaaattagaatcatttttatatactgggtggagagagggctcctcccttcctagtgaatgtccctgtccagggcaccatctcaagtctccaggacaaactagtcacctgagggttctatggcaagcccatcaccacgtcacagggaggcggcccattgggaagatgtcacccaggccatgtagaaaccctgtggtatggccctgccccatggtggtgacacagcagatgcctccttctgggtttggccctcctggcctcacatttaggtctccttttcctatataggttctgactcccgccctaattctgagctctcgctcgccccctctgtgagcccttagaggttctatccctgccgaggcagcattcgtggcccttctccgcatgtgtgaaagggctcagagggtgtccttgctactgagatatataggagctgcccccttttctctcccatgcactgattttagggatgtggcttactcctgagccctgggaggctgagtccctcttctctacagggttttgatttgttttgtttttatgtacatgtattttttcttttttttcttttttttttttttttgttgagacagagtcttgctctgttgcccaggctggtgtgcagtggtgcgatctcagctccctgcaacctcaatctcccaggttcaagcagttctcctgcttcagcctcctgaatagctgggattacaggtgcccgccaccacacccggctaatttttgtatttttagtagagacagggtttcaccatgttgcccaggctggtctcaaactcctggcctcaagtgatctgcctgccttggcctcccaaagtgctgggattacaggcatgagccactgcacccgactgtgtatgtattttgtctatagaaagatttcaccttccctgctcctgggacaaaggaaagggctgtcttctatgtcctctctcctaccttgatgggccccaagatgccatttctgcctgtcctagaagtgcacaaagcatttgactgaggctaggtcctctctctctgatgatctccaggttcaggaattccttgtcaggcttggtcccgagggcccagccagaccttacaggggtctcactccctctctagagtccctgcctctttgggtggtgactgcctcctgttcccctgccatgtgatccccttattggtgctcatctttacccctgtgggtttggagtgcccagtcgggttctcggcttcgtcattctgaatggtggttcagagaggcccaagcctagctctacaggagtgggaggaacctacctggccctaacaatggtacttccagcagaagctgatggaggccccatgagcctctgtgaaacctcactggctgtggggaagggagtggtgggctagcctgggctgccctggatttcactcagggaagggagggtcacactgtgaccctgagccccaagccctccccttctccccctgcccgcttctgtcatattccaggggcggcttctcttcctctcacacccaaagcttaggacttgcttttctgccccttcggtctaagttagcctccttctcctaatcactaaaaaggaaggagaaagccgtcacttcctatgccttccacttcagcttctccccaagcaagctcaaagtccagaaaccaccaccagaacttggaagaaggccatcaaggagctggccattgttgtcacccccaggatcccttaggactcagagggcagagccaagtgggtggcaggagcgctgcattcctgtccagacaccgaaaggcccttggggtttttgaattgtcctggtggagcccagggtatctcccagcctcgccccggggtgtgcttcagcctcatagctgctctgcttccctccttagaaacatggccggggccaggtgctgtttgacctggtctgtgaacacctcaacctcctagagaaggactacttcggcctgaccttctgtgatgctgacagccagaaggtacctgggctagggagcagggtgggacctgctcttccgttaggctcctgtaatcctggccacccccaacagcatccattagtgctcaaatcattaagcatcttctgtttgcgtgtccccaaggctcaaccagccctatccacctgcggttccctgtctcagccatttcttggtgacatacaggtcacccccagatgagaatttagagagccctggtctggctgctagagttgctgggggagctgaggagctccctgctagagcttctcccctacccttgggaggctctgagtttccttcttcctgccagtcccattgcagatgcatcacctgctcactgggactgcctcagggcagtggcagctccgggcactgggtccaagcctggtggtgaatcctggccccattcccctcaccccctagtcccaaggaaaaggaaccaagaggcttagccaaggaagggcgttccctacaaggggctgctgaccagccatttcaggatatttctctctctcagcccagtcaggtcctttcctgcgtcttccctctgaagatctctatcttttcttttagaactggctggacccctccaaggagatcaagaagcagatccggagtgagtggcttgttgtgtttggggaggtgggtgggtgaggggattccaggccatgagagccccccttgtactgctctctcctcctttggaaagtgcatttcaggccaggcgttgtggctcatccctgtaatcccaacactttgcgaggctaaggcgggtggatcacttgaggtcaggagttcaagaccatcctggccaacatgggaaaagcctgtccctactaaaaaaaaatacaaaaattagctgggcgtggtggcgggtgcttgtaatcccagctactcgggaggctgaggcactgggactgcctcaagcgattctcttggacctgggaggcagaggttgtggtgagctgagatcatgccactgcactccagcctgggcaacagagcaaaatttcatctcgaaaaaagaaaaaaaaaaaaaaagaaagaaaatgcattcagatccatgagtccgtgtactccacatggcagatcttgggagaagccagagtgggaaggacaagtctaaggcccagagaagagagacgactgtgcagagtcacacagcaggttagcagaggaatcataaatacattcaggacgccagctctagaagggacctgcagagccatctaggacaaaggacaagcagatgggctggaaacagccacccttctgtccaggaatggtgtagtcttcagtaaacaatgaccctttcctcagaggcccagagagaggcagttattacctaaggtcacagagccaaatgttggctgagccaggtcttgaggcctggtcttccaacaccatcctgtgctcttttcaaggcctggggtgaaggcagatgagcaggccaacaacctgtcctttctggcccagagagagaaagcatgtcgggaagggatggggcagctcccaaatggcagaagggggtggtaggtggcctcagcaaggcagcctgagtagttggagacctggcgcctcgaggcagagatgcctccacccagggcccctcccccttggctgtggttggtctctcctgaactccctggtcccctggctggaaagctgtagctgagcctgttaccatgacagcgggcagctgggcccagggatgccagctgactctgcaggagggggctcgaggaattcttcctgaaggttctgtcagttggagacaaagaggcaggcacacagacagagtgcactcctcggggggctgacagatcctccgcctgggcttcaggctgtcccccaggagccccagcctggctgggaggcctgtctctcatgactaaagggatcggaaaacatataggcagccgagtgtgtggtgtttggtcaggaccaggagcttgggaaagacaggtggctggaccaaatggtcaggtctcagcatccctcccagaggtggcctgcagcccctgccagcacagcccaggcctggtggatgtcactccttgtagccatcccaagtcatcgagtaagtcttgatcgctagcaagtaccttatccaggagagccacagtctctgcctctacccctgtaacttccagccatttatcctcatcctaccttctggtgccccagtggagcaattttttgccctctgtgacagcacctcagccttctgaaggtggtcccattggtccttgtggcctgagcttcagagttgggtgtatctcctcccaaacctcagtgcacctggggcaaggtagggcaaagtagggcacctgggacaagctttccacccctctgggcccctgcttctccttggccagtggattagtagttcctgcctcatgaagtgggggtgacagttcaatgacatatgtatggacagcaccaagcacatagtaggtgctcagtagctgttttcttcttgcttccctgaggcaatctggtgtgatggttaagcagacagacactgaggccagactgcctggatttgaatgttaactccacctgcttcttgtgttgactgtgccttggtttcctcctctgtaaagcagggtagtgctagtacttatatttatgttgttgtgagggttaaatgagtattacatgtagaatggtgcctgcacacagtagcacccagtatgattagctattatttatttttattattattattgattattaccattattattcctgaggtaggaattcctgagaccattgttattcattgaagctgctctttccaaggagtcggtgtggtcaggagcctgggctctggggccagatggccagagttaggatccccattctctaccactgactagctgagtgaccctgagagagtgacataacctctcagaattcatctataaaaaagaaagtcaacttcaggatgattatgaagatcaaacccctgtacatgtgcataaagttcttagcaagcacagtgactggcatctagtaagagtttgagatgtgacatctgtatggtgcagatggtggttaccgcagagacaaggatggtagtgatgatgtggcctccagtggtccatgaccacagccctgccatggatgggcctcgctttctcactttgtcaggggccattttgagcctggaacctgaaatgttccaggggtgggtggtctgaccattgttgtggatatgtagactttcgctaattttgtccagtacctcatatctacctgccttcatcccctctcaagtgaccaccccttctctgggcttgcagagcttgcttccagctataacctcagcctttattcccctgtgtatcttcttagatgtgtgccattggtttttcacatctaagtgtggaggttagcatttatccccctaaaatatccctttgttacatttagcccattatatttaccttttaggtcttgtttataatccaatcctgtcttctggtcttgtttataatccaatcctgtcttctgagatggagtcaacatgatatagggcagagttttccaacatgtgttctgagaaacattaatctttcaggatgctctgtgaaaaatggatacaacagatcaaatcatttttggaaattcttgaatgcatgttcccctcagagagttgcagtgcacagtagcagggtgagggctctgacaagtccaaatttaggaaacctgtttaatgtattatctagacttttttcttatcattaacatcctgcaacccagactaggttgtagaccaaggagccaggtggcctgggtttgaaccccagcattgccacttccaagcagggtgaccttgggctaatttactgcctgggcctcagtgtcttcatctataaaatggggctaatcataggacttactcatggggttgtggtgaggtttactgaagtaatgtttgtaaagcaattaacagtgtgcctggcatgcagcgtcagttttctttctttctttctttctaccttccttcctactgctagctcacgagtctcttaacttgggcctcagtttgctaatctgtcaaatgggaataatgttccagccttcctgattggattgtcctgagattatacataggagaaactttgaaaaactgcccagaggatggtgcatctggaccacccagtggggtgttagggcctcgctgatctctctcccatctcctctcaggtagcccctggaattttgccttcacagtcaagttctacccgcctgatcctgcccagctgacagaagacatcacaaggtgagggctgtggagggagagacaggtgtgctggctgtgtgggactatggatgagggaccctggccctggggacacaggcagtatgtgacagcagctgcaaatgcagtcgcctaccgaggtcaggcagacagcatcgtacacaggaagccgactcattgtaagaaacacagtgatgcaagcacagtggtcagtggcagctgacccttgatgtcagaggaggaggtatcacagggaactgtggggccttttgtagatttaagaggacagaagccacctaaaacagttgctgttcccctccgggccatcactgtcatgtaggaattgggcctgattgttgaaatgaacctagagattaaagaataaaaaccacagttctaaatgttggcaacaaatgcaaactttaaaaaaacatagcatgggccatctctgggtgggacataccaaacccatgtaaaagctgctgtgctgggtgagccaccagtttgcagcattgggagtatggagagggtagaatgggatgcctttgaacgtagaactttggtctgcatgccactctgtgcacacatcaggcacatggaagtcaagtggggcttaggactccccacagagaaaagcctgggctgttggggcaagcgtggactgtgtgtgcagtctcgttgtgcctcagggccagtagataacatggcctgaagattggaaatgagtgcaaagcatccttcaggatgagagcttccgtggggttatcccatttctggaaaccagaacgggggaagcccttctcttaagccctttccaaagagatagtctcacttcatgatatcctggggctgtgtcatccaggtgatgggccttatactcccaacataaaatatgggcttggagttcccctacagcaggggaagggctcctaagccagcccctctctcccattgggtccctccttcatcttcatgttgattgcgtgtttgccaggccatcgaccaaaggtcaaggtgctgactctggccttgggagataagacagatgttcctggaacagatcaggcctgggctttggcgtcattagtcctagttctgagccctgaggtcaggtgcgggctaatgtggcagcagcaagatctgaaactccattcccaagtggactgtgtaggttaggccagcacagcctcaatccccctggtcttccctactgatacctctcctgtttgtgccagacactgggcactgtgcttccagggacaccaggaaggaagttaggcctgcctagcacagatggccccaggagatgggtgctatagcagctgatttcgccaaaaatagttaggcccgaaataaactggtcaaaatgacaaattgattgaaatgaaagattggtcagaatatttggcagtgatttctgaattttgagacttttgaacagaatgcccataagcctgtactcggtgcctgtgatgtttgagctgctactgattctgagtctatgccttggccctgggcgcacactgaggctgcacatactttttgccaggacttcagttctgactgtgaaataatgtcaccaagtagtaagaattattttaagtaaaagatacttaaaagaaaaaagcccagatatggtggctcacacctgtaatcccagtactttgggagacaatggcaggaagattgcttgagaccaggagtttgagaccagtctgggcaacgtggcgaaaccttgtctccacaaaaaatacaaaaattagctgggcgtggtggcatgtggctgtaatcccagctactcaggaggctgagacaggagaatcgcttgaacctgagaggcagaggttgcagtgagctgagatcgtgccactgcactccagcctgggtgacagagtgagactccatctcaaaaaaagaaaaaaagaaaaagaaataggcagttgaaaaaaaatggtgaaacataacaaaaatggacagggaggcatcgttggctaaaaatgaaacttttttttaatacatagtaaccaaaaaagcaataaaaatggttttaaatggttctaaaattgtaaaatcgtccaactgtgcataaaagttataaaaaatcatggcctggtagttggaaatgtttctttaaaccaatttgttttcagacaatttacttagagctggaggcaaaataagaaagttttgggaaagcattggcaagcaggttcatctgggacatggaatacaatgtggaagttaaaatgaatggggtagagtcacatgtgctgacatgggagggctctaaggcctgggtatgaaaaagtgagctgttagaatcagagacagcatttgatgccatttacaggtaagaaacacccataaatcaaaaccacatacatttctggtcatcaagaggaaatttagagtcacctctaaagtgtgaatttttccacaacatgaatacagtatattacttgtataattaaaactatacgacattttgtaatggacaaaccagcaaagtagtcctatttagcttgaaattgagttagaaattgaaaatgctgtcataatagaaaacaaatccctcaaatttagaaatgcacaaaaatgcttaaagtcatgtgaaatgttgcaaaaccatctcatgagacatacccagattgtcaatatatgaagcgccaatgtctacaaacacacttttctgctgagctatgttctatttagttctgatggacagctgtgcttgggggatctagggaggagtagggccctgtgcccatgctggctctcccctatctccagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatataggtaagagggtgccagccagggccttctgtggctccttggccagtgggagccttccttgcaggcctgaatgtcctaggccgccacatactgtgctgtttgtaccccgcctggctctgcccctagcttgaggtatatctaagagcaaatcatctctgtaaataggaacgatagtgactggctgtgtggccttgatgaccttttgggacccaagtttcttaagctcctctataggtgtgataattccctgtccttggcctctgagaataagtttatctgccaactggagaaaataatcgctactgtgtctctgagtaagtgtcctcatgtctagatcttggtgtagagttcaaaagtttggacccgaaagccagcctgctagggttcctatactggctctgccactttctaactagaggatctcaggaaggtcatttcacttcctatgctttggtttcctcatctgttcaaggtggatgctgttaaacccaccctgtaggattgttgggaagcctaaatagcacatattaaaggcacactgcatgttggctgttagtgttgctgtctgtggatcgaggggttgaacagttgatcatgcaggggaaagtacctcgttccagcagttggacgataattaactagtgtgattgtaggctggttatttaacctatctaagccccatttttcacctgtatatgcacaaagttagattatcagtgtctctcaactattggcatttggggcaggagaattcattgtgcagaatgttcagcatccctgggacccagtaaatgcccataacaccttctcagtccttgtaacaacccagatactcccctttgccattgcttctgtacaggttcccctggagaggagcccttggaactaaatgatttgtagggtccttttaagctggaagtatttggggctgtaagtccaggattgttatggggactcaatataattaataatgtgaaggtgcattataaactgtaaagtgcggcacccagggaaaggagtatggtgatattgtctcattactattgaggatggagggaattaggaggccttggttctgtgggcgttatctggagaggagggctagagtcagatgtggagggatcgtgtacgtggggaagagcctgctggggtgtgatgaatgctaggtcaagggtggcaaatgctgtctctgagagtcgcacactaactccacttggttaatagcgactgctgtggtgttgtgttgagtaggacactgattccctacaatgcccaggttagcaatatccacctgggcataggaatagggagtagtggcctgcctgccatctatttgtcatccctgtcctagatagcaagacatcttaggatttgcaagagtcataataattcagagaaagatgttcagatcaatatgggctggagaaatactaagggctgtccctaaagctctttggacctaaagcacactgacatctcgtgtccaagtatcccacacagcagcccagaggtagacaggtcacaggaaactgaggcctggaggatacacaagacctgtaatgaagtgattaggagcataaactctgaagtcacattgtctagattcaaattctgactcttcttcatagcagtgtgaccttggacaagttactcaatgtctctgtgccggttttttcatctgtaaaatgacaataataataatacctatcttacagagttgttatgaggattcagtgagttaatatgtgtaaagtgcttagaacagtaaccagcacatagtactcaataaatgtttgctgtgactaagtataaaatgtagtccaagtttcctggcagccaaagcaaagaaggaacttgattaattacataactcttctttttggaaaggagaatgtgcacctgttccttaggagagattaagtggcttctgatactaaattctgcaagaaatatcctgtgtgggtaataatttaggagcccctgggtgatgataatgaacaatgtccgtaacaatggttttacagtcatggaaaagtagaatttatagctcacagtcaactcagtggcagaatgaggcaaaaatcctgactcccagctcagcctttgtatgatccctggactaacaagactggacttgagctttggcagaagttgggggttgggtgggctgaagtgggagttggggtacaccctcctgctctgagggcagagggaaaagattagggtgaggctcagcatatttgactttctagaatcatgggttctgatggtgggcacctttggacagcaggactaaacctgggcctttcccttggtcacctgtgatcactttctttccctcagggggatgaccccgggagaagcagaaatccacttcttagagaatgccaagaagctttccatgtacggagtagacctgcaccatgccaaggtaccaccagcttcctgggttcccctagtgtctgggtggtgcccccaaagaactatcaggcctttccctagggcgtggtgtgccagaccctgtgttacctccaacttgaaaccttttctgttctcattctcatttctcgaagttccataaccttttattttctcatgatctgtattattttctccatgtattttatttatgaacctgtttgagccactgctagattgggagcattgtgagggaaagacgtaggccttagtttatttctatatccctagcacctggcacatagcctggcaccaagtgtgtgccactaaatatttgctggatgaatgaacgattgagtgattgacagagcaaatgatcaaacaagtgagtgggtgaaaaaaatacctaaatggatgagtgaatgactgaatgactatgggagggattggtcagtgggactccagcatggaggctctaaccctgttcctgagagctcgttacaagcagcgcacagggcagtgttttcggggtgggtggtaggctgtccccaggcatggaccccgggcctcccattccatggtctcttctcatgcaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggaggtgagtctgccttgggaaacactcctcctcaccggaatcaactagaatggagtggaccctggcagctgggcctggactgccaacacacacacacacacacacacacacacacacacacacacacacacacacacacacacacagagagagagagagagagagagagagaggagtctaaataaaagtataaccacatatggccaggtgcagtggctcatgcctgtaattccagcactttagaaggccgaggaaggtggatcacatgaggtcaggagtgtgagaccagcctggccaacatggtgaaaccccgtctctactaaaaatacaaaattagctggcactgcactccagcctgggcaacagagcaagactctgtctcaaaaaaaaaaaaaagggagaaaaaaaaaagaagaaatataactacatacattcaggtcacacagataaatgaatacatgtctgtgtaaagttcatgtatttaggtgttgtaagtatggaagtttgtacacattttaagatacacagactcgactatacatacaacacacacaaatgcaaacatgtatatgtctacacctcttttccttcaattacctacatctcacccatcaaaaagcccatttggttgtacctgtagaataaacatgaacccatttgcttctcttcctctccatcacacccgcctccagcatcccccatcttttgcctgtgcctatgagggccttctccctcgcctctggtgctctccaggtcattttcctcatagctgctggagagatcttaaaaagtcccttaaatcagatcatggcaagcccactcccccttcccatccacacccttgcttacacctttcaggaactctctttagctcttgagctaaacttcaaactccttccatggccacctacctctcccacctatcccttgccacactgccccatgcccaaggtgctttagcctcttcggccttgagatctttgaataagtcgagctctttcctgcctgagtgcttcgcatttgatgtttcctttacctgaaagtatctccccctctcgcttctcacatagctggttccttcccattcttcaaatgtcagctcaagatcacctagatctaggtctagaggggatcccctgctcttccttagatgacaggagcccctatgccttcccagttctgctgcaccacacatctcccttcattccccttgtagccctgatcagtgtctgcaattatcttgtttgcttatttgttattggaggtccccttcccctactagaatcttctgccttggtctccatgtatctctagtgtttagcactggacccgtcacagagtaagggctcaatcacccttattgattcagtgaatgaacaggccaaagtcgcagatgcctgagaagagttcagaaagaatgactcacgtctgtaatcccagcattttgggaggctgaggtgggaggactgcttgagcccaggagttggagaccagcctaggcaacatagtgagactcattctctacaaaaaattagctggtgtggtgtcgtctgactgtagtcctggctacttgggaggctgaggcaggaggatctcttgagcccaggaattcaaggttacagtgagctatgattgcgccactgtactccaccctgggcaaatgatcgagaccctgtgtctcaaaaaaacattaaacaaataaaataaaaaacacaaagaatgggctagtggcgagagtgagctcaggccctgcctctaacctgcccttttggttttccagtatgagcaatttgagagcacaattggctttaagctcccaaaccaccggtcagccaagagactgtggaaggtctgcatcgagcatcatacattcttccggtgagcctgaccttggatggggtaatggggatggggcagaggccatgtgtatggaggggagcagggggaggagttagtgagaactctaggaaagtcctccaccctttccccaagtccctcccttcctggaccactttgaattgttgtagttggtggagtagtgggatgaaaggccagctgtggtctaaccttgggcctggcagtgcaggtctgattcctcctcctcccctgcatccctctgctgcaggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggaggtatggcccaaattggagggctgggcggggaatggtcttcagagggaactgggggagtgggcatgctgggttctgcagaatgagcaggaaaatggtagatgcatcccaagttcatctgcaccaggctggcccctcaagaccagtgctgtccctgggcagctcttggtggcttagtcccaacctagagctcactcccacttgagatgtgatactaccactctctggattccccacaacttccctgagtcgtggtcttttggggtcccaggtttagccatatggtttgggccacctacccaagaagcttagcaatccaccagtctaacctgtggtctaaccttgggcctggcagtgcaggtctgattcaccctcctcccctgcatccctctgctgcaggctggtgtcccttacactggtcatcatcatactaggagaatagtgtcttatgactgcagtgtggagctgatgatgccttatctgctgggaggccagggcatcgttcttggtcattcttttggttctactaggttctgggctgattgacaatctaaccacatggcactctccactgtccccatttctattggattgatgggtgcccttaacatcaatgaaaactggccctatatagtcctgtagcaagcagatagggcttaaaatgtggtgcacaaaccacgtttcatcagagtcgcctgtgagattgttaagcaagcacgaaaattcccaggttttgccccagacctactaaatcagcacccttcagggcccaagtctctccccaggatgtacacactagagtttgtaggtgatgttcggaagtcacatgggtcactggggagattcagaattatgcagatctgagttcaaatctcggcttgacagtcaccgtgggctgttctctggacactggaagtggttcataaatatctgaatgaatggatgggtgaccttaagcaacttatttaactccctgagcctatttcctcttctacaaaatacatagtacctactttgctgtgttctagggaaaactaaatgagatcatgcctagaaaatattctgtggcacatagtagcaccttaagaaattgtacccatcattattgtttttaggtttgtagagagtggcttaaaggtgggaagtgggggctgggcatggtgactcatgcctgtaatcccagcactttgggaggccaaggcgggcagatcacctgaggtcaggagttcgagaccagcctgaccaatatgatgaaaccccatctctactaaaaatacaaaaattagccgggcgtggtggcatgcacctgtaatctcagctactcgggaggctgaaacaggagaattgcttggacctgggaggcagaggttgcagtgagctcacaccattgcattccagcctgggcaacaaagcgagactccatctcaaaaaaaataaaaaaaataaaaaataaaaaggccaggcacagtggctcacacctataatcccaacacttcgggaagccaaggcaggtggatcacgaggtccagagatcaagaccatcctggccaacatggtgaaacctcgtctctactaaaaatacaaagattagccaggcatggtggcaggcgcctgtagtcccagctactcgggagctcaggcaggagaatcacttgaacccgggagatgaaggttgcagtgagccaagattgcaccgccactgtactctagcctggtgacagagcaagactccgtctcaaaaaaaaaaaaaaaaaaaaaaaggtggaaagtggggacttgggtagggaaaccgtggatactcccagaacaccttggggcaggcctccaggcaagttagttctacttatattttctgagtgttatatgtgtgccaggccttgtgttgggtcctgggtatagtatttagagtgaataggtttggtcctttcctttgaggagctcatagaatagcaggtttgtaagcatttgttgtggttcaagcaatgggaaaagcatgtgtagaatgtagagtagccatgaggagggaggaattaagtctagaagggacagaaatggctctgcagaaagggtgccaactgggcagggtttggaaggatacctaggagtttgccaggtgattaagaaagtctgatactttgtctggtatatgaaaatgagacctgtctcaggactcctgtgcatgtttgaaagatgtgtagttctgctagggttcatctgaggctgaagaagctccttcttctccttgggtagacagaggactgacaactggggtttatgcaaagggaaaggtccctcccctgtagcttccattactatgtcaggagccaaatgaagcccagattctggcaggcagcagaggttagcccagagctggtgaagctcatcggagaggagcagaagcatggactctaagctaggaggccttggtccctgtcccaactcaccaaaaggtcaccagtgggatatttcccctcttgatgtctccagtcatcctctgtaaaatggggataagtcagtcccattccagccatcaacatagggtattgtgtaaatcaaacgaaatatatgcataaatgcgtactttgcaaagtgagtgtatatgaatagaaaggataattatcctcttttaaaaatctaggccaaccccaaggataatctgagctctggttattttaaacccgtgtttttcagcctattttctaccaagacacaatccacgggcatagtcggattatgcccaatgcgtgatgcgaagtctagttccaccccttcctttcctattcagaaaagcattttggaataccagtgagtgagaaaggtgttattgcaggcatctccctgaattctccctaatttataaagaaggtaaatcagttgcaaattttaggactttagctttcactagtaaagctagtctcacaatatttgtgtgttgctaaatgatgatcaagtgagtattctaccacaaccaccacaaccaaaacagcaacatttatgggctgccattgatggaagcctcactctgtgccagccactcttccataaatatttatatacattagcttgttcattcctcacctccgctttctaaagcaggcactgcttctagatgaggaaaccaagacccagcaatattatgtaacttacccaaggtcacacagtcaagaacagatggatttgagatttgaacccaggctctagtgctgtagaaaccaggaaggagtcctgggctgggaggcagctctgccactcactggccatgtgatcagaagtctacttcacccctctgggcaatgggtgaggggtgtggaagagttggctccactccaggcgtggttgggcagggctgggctggttctctgtctgttctctgggaggggtctcacatggttgcctggctatctccacccacttcagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaaggtaggagcctggctttctcatactctctgccctggggatcaggaggctgacctgaggtctagcctcggccttgaccttcacatgcctccagctgtggccaagcacccttactatggagtgcaccatggcagggccttgcctttgggtcatctctcaatacctggcccttgccgggatggggtgggcatgggagtgggcatgctgcctgtcctgtactctccccagctttgccctgcttttccagaggggcactctgtcccctagaggactcaggcctccttttgcacactcttaatttgcccctctgactgggatctggatctgcaccactctcttcctcctcagagcatgaccaggtgtcaccaacagctctaggagtgtgaggttcaagtgtgtccccttcctatttccccatgccccactcaggtgcacacacacagtcccagtatctgtgtgtacacgctcatgcaggattgcatgacctcagcctcacactcacttaataacagatgtatgcacccgtcacccttagatccatgcacacagatgtgcaaacaacatgcacacacacaggtgtgtgcacacacaggccagggagagcttcctcttggtatagttgttcagcaggtttctttccgtctaccttgtgagcacagggccttgaacatgctcccactgacagcgagagcagggaactccattctcacatcccatctgcccagtgtggctctgcccacttggcctctagttcccttctctgccttcctgggacagcaccctgcttcacacctgtaccttcttctgactacctcactgccctgctggtggcccacccagctgccctggcctccacttggtcgagtgtgcgtgctctgggctccttgctggaccaagcccatcgtggtatctctaatccatctgctctactgaccctgctgctttctttccctcctaccacatcccactagccggagcaggaaaccacgccgagacacaagcaggaggtactgcatgggacctgtccctccctacccagccgttcccatccctagctcatttgtcaccatcccacagtccatcccaggctcacttccctggcaccatctcagcttcaacttcatctctgctccccagccatccccctctgcagccgtccttgctccccactccgccacccgctaagcttctctctccagctcccttcttagactctcctggccaatcggccatctctccctcctccctcagccctcccaccctctccccagctcacccggtcctccatacttgcagctcacctgctgaccatcccacctgcaccaccagctcttccaggccattctgtgctttcatttagcacatctcccctgacccaccccttccctagattcatctcctgcccgacagcactgtttggtctcgcctccatctcgtctgtgtcccctgtgtcctcacccctagcttctttttgtatctattggcagtcagatgtgggagtggggattgggggtgggggagggaggtgcctcagagcacacctgcatctgccccaactccagtcctacacctcccccaggcagggtcgactactgctccgctatggcaaaaacctcctccttttctcctcctttcctcgtcttcttcccatttgttgcttcccccaaattattccttccatgttaaccacttcttccctctcacacagtcaccaactcttcatctgaactttaactgcaagagaagtgggtttattcttgggctgccaaggtaaagggccagagactgggacataagaagagccttgccttggagtcctgagatctgggtttcaaccccacttctgccaccaactctttgaaggtcttgggaaattcccctcaggccccagtcccctgtctgaacagcaaagcattcagactaggtttctccaatgcccttaacctttagggatcccaggaccccaggatcccactgctccctacagccttcagggacataacacacccacggaggcagtggggcaggtttgtgatggaagacgacaagccacatctcaggttgggactcactacccattgcagcccaaaccctctccctgtgcaagcaccatcaggtttgacttctcagacagccatggtccagagggcagctcagcttgggaagggatgcccgaggaacagacagatgtctggagggaaagcaggagcctcactgggattggtttccttcctgaggtagcttaggagtcagccatagtggatccttgggtaccagagatgagcccaggggaagattctagctttgtccaagggtaagcttaccttccagtggttcttccagaattacctgatctgactttaataagctgagattgtccatttcttgtcctgaattgagttaacatgaatttttaagcagccttgcagataagcgtccttgggctgccagccaccactttgccccagaagtagccagataaacagcttttggcaggtccctgccagctcctgcacaaagctcgtcctcccttgacctaaggagatgactctgtcatgctgcactggctgggaacactacccatataggtagaatcctacaactctggctatacctggctcaattcttgtgcccagctgtgggacttactgctcttcttcctggtctctaattctcctaatcttcctgaacactccacagcattctagtttctctatctggctgtatctcaccctgtctgctattggtgagtcagtacctgaaaggtatctggaaggtccagggtggttggggaaggtagtgtcccatcacagaggagactagatgcaattttttcctgcccctggtccctagtgtgggagcttggccattcttctggatgtccctggcttgaggaggatctgtactgtgggcctccccagggcctgagcagttgtgcatgttgggctaggaggggcccagactggacatcctgttaagtacagtggcccaagtctcagccagaaagtggacactgggatccaggagggatctaggaggcacctgaatgagtcagagcagcccagtgaataggattagtgagttattatagctctctggcagttgctgcctgctatgccttagttgtaacagagggaagtcacctctgtgactaagaccgggcttatagcaccacagggaactcacccagacctgtgggctttgggtagaggttggctgttcagaggctgtagagccaggcaagggagaagcgaaggtggcttgactagacatctcctctttttcatcttcagtgctctgtgccttgggatgtgcacctgttggggtggttctccttgccctggtttgtctctggggctgccatgagagtgacacaggtcagagtgggaataacgttgctggtggagggtggtgatggtgactgctgccatcatccctgcaccctgcatccccgcttggagctgttcccctaacaccaccaccctctccatctatccctagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgaggtaggtgtcgccctgaacccctcgataggggccttgggtaaagagacattgggttgctgcatcctgacttacactcatcctccacaccaatatgcttcccccattgctgcttaggggctggtggggatggagagggtggtagattaggctgagggagatgaattcactaaatcttggaatcctgggtcctggagaccaacttaaaacatgaaaaactcaagactcatggtagcttggcgtactccccttccatcagcccgagtataatggggaaggggtgctggttagaaatgcaggtttcagggccccagcccagacctactgaatcagatatttggactcagtgctggcatcggcatctggacaagtgctgcagaggcttttcatgcacactacattttgagaatcccaatagctctctccagaaccagaccctgttgtgcctattgtgaaaacacggatcggggagtggtccctcctagaaggggcttcggagtccactggaggggaatgggcccttcacagaaatcagacctgcttctgaggcttcagaaaaggatctcacatgacctgcctttccgagtggaaagagtggggtgttttctcgattgaagaagagataaagttaggatttggggaagcactgcatttagactctcaagtcagtatttttagcccttgctaaatcttggcgatatttaccccagtttatacttaggtgttttctccctgaagctattgcttactggtctcaaatacggttgtggtgtagacttgcactgcctgggtttgaattctggctccgctgcctgccagctggatgactttgggcttgttacttaacctctctgaggctcgttgggtagagataataaaagcacctacttcatggggatgttgtaaggattaaacgagataatgcacgtagagggactagcagagtaccttgatgcgcagtgtgagttattgtttcacttgagagttccagactcttccacagaggaggttaacttcaaatcaggataaagaaagcatgtttcaatccaaagtgttaaagtcaagcatactaatttaactagaggcattcacagacgacttttctttaacaaataaaattcccctttcctaaataaaataaaagttgaaagggccctgggaacctgctcagaaccttcattttacagataggggcaccgagacccagaaagaggaaggacttattcagtgtcttagctgatggaagaggaaccagaacccaattttcttgtgacccaggctattgtatgtgctattaaatcacagctgcctaggagcaagaccaaatcacataaagaccaggtagagagtcaattgtatgtgtgctgccctctaatgctttgaaaattggtgatgcacccatgatctaattagcagagcattttattggatcagtgctaccatggcctgaacctgccagataacagacggctttgtctagtaaggcataagtccagagagagctactggggtggctttctggtttgtgagtcacagaattagggatgctttgggggcctttaaggctggtgctgtggaagaagggcagacctctgcatccatgaagggcctctgtttgcctctggcacaagcaagaccctgggctgggtggcggaggctggtctagtgatccagtgaacaacatcctcttctgcccttcagcgtggcccctaatcaatcctgatgtgggctggccaagcttggcctggctgtgggcgaggtgggatgcagaggctactgaaagagtgagtctccagaagagaaggggaggatgagccctgggaagtgaggtctagacctctggagtgtctcagtgtagcctggtgtagggtgtgccccacctgctggtgatagctggaactgctagaagatgggtcttagtaaaaggtggaatctgctccacctcccagccctgctcagccgcaagaagtatagtccactgctggaaagaactatggtccaggagctcaccctggagctatggaccattcagaactggcttacaggcccccttggcatttaggggcctttgaagatttgggagatggggaggtgccatagacaaggattgactggctccttgggtaacttcccctttttgagccgcattgcctagtccacctacaggaggaccaaaatggtcattccatagggtagttgggaaagtagagtgaaataattaatataaaagcactttctcaactggaaggtgctgggcagtcatggggctgttgctgttggtgactagaatccctgatcccaaaatcagttttgtggggggcatcctgaagatgcctgtgtcatccagaattcctagcagcctcctcgtatattgttgggcctcatctgggccaaggggaaaacagagggaactctaactgttcccatttgccaaacccaagtttcagtgtttaaagggggctgtaatccaaactgcagggttgaaccatagcctaagccagagacatctggagccagagtctaaatgatatggctccaacatctctgaatgagagtgggcaggccatgggggaagggcactggggctgactgtgggcctccctcccttaagtggctcagaagggcagtccctcccgagctcaccccacagagtggctactccctgacctaatccacaaatcctacagatatgggacttaaaaagctgggctatttatggactttgtgtgtgtgtctctctctcctactttttctctttccctctcttcctgtctctgtctctccttcccttcctccctctttccctttcctctggctctgggcctcccctgcagtcccagaggacccaggacatctctcagcgggacttggtacctgagcctggagcagccgcaggcttggaagtgttcactcagaaaagcctcgcagcatctcctgaggttactgtcttcaccttcctgtgccccttcctcctgcccacccagaaccaccctctgtggtcttaagaaaaccctttctctggggtgaggggaatgtaccagattctgccaagcagttggaagcaatgggtaacccatgctgtctccatgctgtgataaggaaatgtccccatcccagagatccataaagggccagcccctccctcatccattgtttctcaggagggacaggactgcaaccattctgggaagacagaacagcctgcattgcctttggcctcgaaggagaggcaggaatgatctccctctttcaggtcctggtgaggcaggtgactctagaggcaggccctgacttctatgcttagggtcaggggtcatgctagaggcaggctctgacttccatgcttagggtcaggggtcatgctagaagcaggctctgacttctatgcttagggtcaggggtcatggcacccaaatgccttctgccttaaggtcttttctctgttcagaagcctgaatggtctagcagtggttagttagggcacgacattccaggcatctccggcctgcgtcttctctgaactcccctggagcttgggcccatcaaggaggcaggcaaaagtggacatctttctctaaggagtatccttagggttgtagagagattggtcaggcaagtgtttgaaatgaggaggccattgcttctatgcccagggcggcagcaagtggagggctctttgaacttcctgtggcccttcatggatgctgggcatagaatccaggcccaggcaggaggctgtgctccctcctctgatgggattttatggactatcagggttggaagctactgagcgatcatctgggcagaactttcttccccaatatctgccgctcccctgttgatgtatgctctcctctgagggcctgtacctttctccattctcagagaaaacttctttagctgctgcaaacgtgctggaactttaagaaagacataaatgagctacataagtgataaaacataagtcatacttctactctatgaatttttcctcaatctaaagaacaaaactatccgcacactctcttgagggaaatcggacaagagtcaacagcataccaaggacagggctagagagatgccctggacacagagatgctcctgtgaccaaggacaggtgcccatttggggagcagagcccacaacctgcaccccgcccccgcatcattctcctgcaaatgtccatccagctcttccacagcaggcacttttgctgtccttggcggcagcccattaactattgggaagttttcgtgttgaattgaaatctgccttttcaaattagcagcctgtaggtctcattctgcccgctggtgcccgctaccgctctgcatcctcctccaggccagcccttcggagacttgaacacctccccttccctagaacacttcactctcttcccactttctcccaggaaatggtttctggagggccccttaccctggaccccctcctcgtataaagggcaggcctggctgggcatggtggctcacgcctgtaattccagcactttgggagactgagttgggtggatcacctgaggtcaggagttcgagaccagcctggccaaaatggtgaaaccctgtctctactaaaaatacaaataataataataataataataataagctgggcgtggtggcgcgtgcctgtaatcctagctactggggaggctgaggcaggagaatcgcttgaactcgggaggcggctgtcagtgaggcaagatcacgcctctgcactccagcctggaagacagagcaaaactccgtctcaaaaaaaaaaaaaaaaaaaaggcaggccccaaaatgtgacccagagctccaggaggggcctgaacagcctggagtcaggagaacagccaggctggagagtttcctgtctgtgccttgggtgcagacagctgtgagcccaactggctctgtttctccccacccctgttgccagcttcctttgctgcagtgcccctacctgacggcagggggcgctctgagcaaggcaccgacggtcccctggctccagaaagaatggctgcggggctgcggctacctggggctaccctaagattatcccatcttgtgattcgggttagaacgactttcacgccaacccctcgggccaggtgtgtggctctacccgtgccttcgcaccgtggaagtttttttcttttttgttcagttttcttttcctcttcaggatcctacattttactttgtcccccgctgctcagcctgtgatcttgcgcatggcctctcccctctgggataccgtttcgccttctgaaataaggataacgatatctgcttcacaagttgccatttggattaaatttaataactcagacaaagggctggcattgcctggcacatagcaactaacaatcactatacgtttcccctttcttcctgcagagtctacttttcattctctgccagcacctgcgccactcactcttgcttatctagcctagttgctagttagaattggggcaggaatgttccagaaggaggcatattgactggctttggccatcattgccaggcggatgtcagtacagctggaatggaggcagctgaaggaacctgcttctcaaggaaatgagcaaaaggacctagcttccgtaggctctcaaagcacgtccctttgggatggttcaggagctgtggtcctgaagccttaatgacctgaagtaaaagctcagaaacccaccccagactttacctagaccttccccccttccttttatctcgctttcccatgaacaagattattttaatgggttctgattccctgacagagagattttctcaaaacacagtggggacagagggtttatgatgctctcttgagccttcaaaatgtttcagatcttatgggatctgacagactcctcctccctgtggggtgggattaacagactcctcaccaagtcataacctgaaaaggagcccaaggtcatataaaccttccccctcctgctgccaggagaagttctgggcatgtctccctgtggaggtggtcatggtagggtggagaggacacacttcacagaacttggcgtcagagactgagttcaaggcctgcctttccacttgctccctgtatggccttgggcaagatgcttctccaggtctgagtttccatatctgtatcacgaggggctctagttggggcagtgaggagggaggtacctcagggcattaaggccgcccacacccccaactttaccagggcagctctgtatttctgtcacatagccgacttgcattaaaattttgtgggaagtatcctgtggccacaagatgaaaaacccagtgaccttcctgcttttctaaccaccctagaagtccatcatccctcccaggcattgtttgaagaactcttgggggaggtagaggctgttgggagatggcctaacagtgctgcgatctggtgcttttttttttttttttttttttttttgagatggagttttgctcttgttgcccaggctagatagagtgcattggtgcgatctcggctcaccgcaacctctgccccgcaggtccaagcaattctcctgcctcagcctcccaaagtgctgggattacaggtgtgagccaccgcgcctggcctttcttttttttagacggagtctcgctctgtcaccaggctggagtgcagtggcacagtctcggctcactgcaacctccgcctcccagattaaagcaattctcctgcctcagcctcccaagtagctgggattacaggtgcatgccaccatgtctggctaattttttgtatttttagtagggatggggtttcaccatgttggccaggatggtcttgatctcttgacctcatgatctgccagcctcagcctcccaaagtgctgggattacaggcgtgagccaccgcgcttggcctctggtgcctttgatgcacgatgatgcttagatctttacctctctcccttccttgatgcattctattgagttcttttctgctctttctatgggttttgttagaattagaatgggccctggtatttgtttcttttagattgaacaccacagtgttcaagctgtttaagccattgtggtgcctggcactaacgtggtcatgtggtatctccatgactactatgctttcttcccagaagcccttgtagaaaggttcgatttcaggctgtggcctgtggaacttaatgcatcccttcaatttgccattaggtcacagttggcacccatattccatggttgtgaaataagttagcaaagatctccggcctcaaaaatcaggctttcttttcctgactctgtcttctactaacagtgaccttgggcaagtcactgtccatctctagacctgtttcctcatttacacaatatggaaatgagactggataacattgtaagagtacttttgactctaacattcaaagactccatgtgatggaaatgactttcccctctgacggtggcagttatgttattaaaagaggaagaggaagggtcctggcccatctgtggatctccatttccccatggctgacatgggaagggcataagaccccatcccattttatcaagttgggggcagtggttgaggaaaattggtcaataatttatcaagtgcctgatgggaagagggaccttgatgagaatggctggcacgtcatgccttcctctccccagccagttctggggatgtgctgtcccaaagtcaaacatttcagtggtagattggtcccctcttacaaagggaaaaactcacccattcttcaggtacctgatatttcatgttaactcttcttgctccaattgaaacacagggttcagagcattgggtatttatagaaagagagtacactaggccagaagagctcggtctcctaaaagtgaccaccatgcagcaggaagaaaggcaggcaggccttgctggtatccttgccaacggcagactctccaaggtagacgttctggtggacaagttcaaagtggaagtggccacagaagaaatggtgggaaacagaagagcaaacacccagcaacaaggaaaaatgattgcaagtcctgaagactttgagtcagtgggggaggaaggcccctggatcagggaaagcccaggaggggctgccctggcttccggccgcacattggcagaaaagctcctcgagggctctgagctcagggcagacaccagagaggcaaccatcaggaaccgctgcatgtcagatggtcagccggagggccagacagagctgaggaaggggctggaggagcctcacacttgtgggagacccactgctccagggaccaggccagcagaggtggacgtcctctctccagcctccgacaagggaggactccagtcgtttctattggatccagcccacgcagaagccagagctgagttgagcaatgaaactgatacttcctttgcagagaggagcttctatttaaattatgaagaaaaagactcagaagaccaagtcctccctccacccctggaggagagaaaagggcgcctggatgcccctcccggaggtgagcccaggccgacgctgaattccttagacctgagggtttctgctgctgcttccagcaggagcaaggacgaagcccacatgacttccccaaaggaaggggcagggacccccaagaaccatggaggacctggtgacctgaagggatctcccgcaggacagacgtttgctgaaggctgggaagatgcccagtggggagtggaaggagagtttccccacctgacagccagcgcagcccgagaggaagggacccccgtgagtggagatttgctgggaaaggctgaggaaagtcccacagaggaactgaagaagcaccctcctcacagaggacagggcgtgcatcccgacccccaggcctgcgcccttcctcgggccatccctctgaatgtcaggaagccagtcaaaccagacagaggcaacttcccacccaaagagaggggagtggttcccacccagaaaggaggggctgagctgaaggaccgcgaggcttcagcatttcttcacatggaggtgatcattcccctgccagcctcccctggtcattctgaggacctggcagctctggaggaagcttctccaagcccaacctcccatgggtcaggggagccttcggagctcagggagccctttcttagacatgtccatctttcgaaagccagcccagagcccaaggaccaagtagggtttgtggtgtcccctgccacaggaggtgagcgcaggcctcctcccatcaccagcagaaagcccagagtagtccctgaagaagctgaggggcgcatacctctggggtttgggttcccttcagggaagcgaagggagatgacctctttccaggctggggaccaagagggctccctagaagatattagcaagacctcagtggccaacaaaattcggatatttgagacccacggagctgaaactcgccgaatgagtgagggtgaagcaaggtcccttccaaatgacgtatcttcagaggcacccgtgggacaagcagagcagcagcggagtacgctctcagacctgggcttcgcccaactccagcccccaggggactttgccagccccaaagccacacattccacagtgatacctctggctaccagacacttcagggaggacacttctgcatcctaccaggaagcacacacggaactagagcccgtgtcccccaattcaggctgtgaaaccacgctggcagaagctactggaactggggtaactggccgcgtgagcccccgcccccaccgctgctccccgcccatgggggctggccgcatgctctgtagtttttagaagcatgtttcagtggcccctcgtcatttctgcaatcagaggctgcttatccatccctgtgagttttttccctaaacgggcctgggtgtagctcaggctgaatgatgggcttctctgcttggcccatgttagcttggccacaaagaccctcagcttttggtgtgacctggtgcccagagggtcacacaacccccatggagaaggtggcgccaccaccagcaaatgacacacctgctttgccttgccgctcatacccgctgggttcctgcctaccttgcttggcttgtccagcgatctttcttcatcctttcccatccctggttctcccgccttgggaaagttgacagtccagaggtttccatccttcacttctggttccctctcagtcccagtgccaagtttctttctgcctccttaagactaactgtcttctctaatccagaacaaatccggagatgcggtcagggaagagaagcgctccaccaacttagcagccaacacccctgggaagggggggcgcctgagatttgccagcccctcgggccctcaggtctctgcagcccctctgtgccctgatgacccagtcaccttcacccggccaggatgcatcgccgccttaggttcccacctgctgtggcagcacctctcgtgctgctcaactctggcttgtctggaatgtctccctcacacctctcaaccttccagaaactggctaaatggaggctcgcttagcaagtgaatgtctaagcccactgaatccctagaaccagaagccaagttctttacaaatctttcatgggtattaggttggtctttaaaaagaatgttatgaaccagccaaaaatgtgtgtgtggtgtttaatccctgacaggccagttgagaggtatgtatgtcggacaagagttgctggttccccgaggcactgccttggcccgctgttgtcaattacactgatgggaccagagcctctactccctgacttgcctgtggtccactcatggagcccagggtggagctggcgtagcactcagctcccaagaagctcgtgcccaaaaggcctgaccctgaattgctcttctctctagtcgatgctgacccctcccccggagactcagtggaattgacaaacatgttggcttcctcttttgttcctcaaagttcttggctccaacctctctgccttcccttcctgggtctccctgaatccctggatctccctccttagtttctgtttctcaacgcccacctgcacggatgggcctggggtccgggcttccatccctgcctttcgtgcaatgctgcttccaataagctcccagatccaatacccttggatggagcctcctgtccaggagtcactggcaggacgtttgctttgtacttgcttttgccatcagtgtgagaccctcagaaaggggcatctccactcttgagtcgtttttgttttttttatgcttgttatgatttcaaggaacctttcctggggtgtttttcatttcctggcctgctcttccattcaggatgtcgacacagccccgagatttctcctgacattcaccatcttgatttctctttctctctctctccccaccccacatccccattcttttgattttatctggccatagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgaggtacagtggagcttcctcaagagccaggcccgctgggcaccgcatgctcagagggccctgggccacccgtgagaagaccgagcacccagcctgcagcctgaagctctgtctcgtgttgcatgactgcccctccgcagaacagcatggttctgtgctcgcatgtttgccatctcggtttacccctaacacgcgctccttggtattttaaccctgtgaccccatcgcttgctgaagtcgagcgatgacaggtagtctggtctttcttgaccccatgcccccccacctgtgttgcatggcacctgcagagagcatgcgtctgtggactcttgggggctcctgcagcctggtctgaaagctgaatggtttttcctgatccgggcccaggcttgtctctctggggtctgggcttcccggggaaggggaagcagtttaaatccatctggccctggggtctcagggtggtaatggaagctcctggaagagaggaaatgtggtcattgaggagggacagactgtctctgggcctctctgtggtctcctctgtagagctgtgaagggatttctctaaggcacgcctgcccatatcattcctttgccccctcatctcttctagacccaacctccctcctacactctcctttccccaacattcctggcattgaaatatgagcttagccactctgggctctcacttcatgctatattctctgagcaggtttttttttctccctttcggtgccttacaaacctatcatgttccaggaccaagttcaaatgtcagtttcctagcaggggtttgctttcctgaccaccctgggcagaaatatcgcccccctacccccttgccctgtaatgcctatgctccagcactatccaaagcggtcaggtcagtggctgacaagcctgctctcccaccaggtggcagctcctctaggcctggcatatactaggcactaatagatgattaactggatgaatggctgggttacagggttgcaaccatctataagaatccccttcagccaggcacagtggcttgtgcctgtaatcccagctactcaggagctgaggcaagaaggcagggggatcacttgagcccaggagttcgaggctacagtgagctttgatcgtgccactgcactccagcccgggcgacagagtgagaccttgtctcttaaaaacaaaacaaaacaagaaaaaaaaaatctccaggcacagtggttcacacctgtaatcccagcactttgggaggctgaggcaggtggatcacctgaggtcaggagttcaagaccaccctgaccaacatggtgaaaccttgtctctactaaaaatacaaaaattagctgggcgtggtggcacccacctgtaatcccaactactcgggaggcaggagaatcacttgaactcaggaggcagaggttgcagtgagctgagatcacgccattacactccagcctgggcaacggaacgagattccatctcaaaaaacaaaacaaaaacaaaaacaaaactatactcagaggtcatagtcacagcttgccatacccaaatggaccccacatgctctctacttcaccccagtcctcaacaaaccctcttcactcattgacatctcctgcctggatgctgtaggcctccaagcatgtgtggctcttgctctaaagaagagtccaggctgggcacggtggcccacacctgtaatcccagcactttgggaggctgaggcaggtggatcacttgaggtcaggggttcaagaacagcctggccaacatggtgaaaccccgtctctactaaaaatacaaaagttagccgggtgtggtggcatgagcctgtagtgccagctacctgggaggctgaggtaggggaatcgcttgaacctggaaggcagaggttacagtgagccgagatcgcaccatcgcactccagcctgggcgacaaagggagagtctgtctcaagaaaaaaaatagaagagttcagctgaagcggctgagaggtggtgagctcaccaggatttggtgacattatgtacacaaggaaaacacttagcccagggcctgtcatagagtatgttaatgaaatggtagatgttctaatagtagcctaaaaaacagcatatagccaccatgagggtgtgtggcacaggggcgcagggcaggcctgcctggtcctggtggtggtcctggctctcctcgcgggctatctgtctatgatatcacaccacaactcttttaccctgtccagagtacccttccagagatgtggccagctgtggggataggagatagcctgcagacaccacactgcaattgtctgtgagcaagggtcatgctagggtttcagttacagagcattctccctccttttcctacagcccgtgaaaacagaaaccatgactgtcagcagtctggccattagaaagaagattgagccggaggccgtactgcagaccagagtctccgctatggataacacccaggtaacttgtgccttccaatgtaccctaagcatgggtattgggcatttggtggtagggtccccactgctgtggccaaaccccttggccagctcttttaatctcagcttccctggaacccatatgttaatcctgatgctctcctgtgcctcagtgtcctctctgagctctggggaggggcaacgggtaaagcaggttcctgtcctgggcagaccatacttcttaaagcctccatttagccatccataaaatgggaatgaccctgtctaccccttcctcctgggcatattgggaggactgtactgactagtggattgggaccttggtgttcacattgcttggaggagttggagaggtttcttgaggtatctcaggggctgcttgaggagagaagagggagagatcccaattcagcttcagtcagaatagctcaccttgggtcattttttatgcattagagttccacatcagatcagtaaaatgaacaaagtgaaagaagaaaaccgaagatcatgtgtcttgacaagaagcagcatcctgaccacctggagaaagccgtcaggcataggcacaggcccacgacttccagtccattccctgcactccttccatgctttttaaacttaggaagttaagattgaggatctgatagatgccctcctggtttttcctggccagaagagctacaatgctaggagcttttttgctctgagactaaccttttcctgaagaactgaaataagaccaggcacagtggctcacatctgtaatcccagcactttgtgaggccaaggcaggcagatcgcttgagcccaggggtacaagaccagcctgggcaatatagggagaccccagctctacaaaaaatacaaaaattagctgggcatggtagcacatgcctgtagtcccagctgctcgggaggctgatgtaggaggatcactaaaacccaggaggtcgaagctgcagtgaactatgagctatgattccaccactgcattccagcttgggtgacagggaaaaaaagagagagaaagagaaaactgaaataagacataaaccaatacaacatgggcaattcttttgtttccagatttctttctcccacttttataatgatggtaggagtttatgaggccgtctactacaggtcaggactcttgagttctgatgagctgtgtgaccttgggcaagctgcttcccccactgacctgttttgttttagtaacacgtgtttctgttgtgttttcatacagaaaagtataaagaaactaaaattggccctagatcccacagcccagtaacccttattgacataaaaacaaaacaacaaaaaaagtttatagttatacaattcaagcagaacaaaatgggatttttcttataatatcacccagaaaaaaatataagcctatttcaacacagatacctacatctctatatacttaacaatgtttacacagaagtgatcattttcttacaacttacctttcttcttagtaattattttggagatcactccttgttggcatacatagacccaccttactcttgatcatctcagttaggaggcaaatcttgatttatttcgctgtctcccaatggctcgccctgtgattgtttttgttttgtgcaattcactatcagcgctcgtgaatttccttgctcatacttctcggtgagcttttcaaaggttatatccaaagagtcagttcctagagattgctaggtcaaagattacacgcattgcaatttggatagaatttgccagatagtctgagattattttttatttaccaaatacactggttgaaatgtaatgagggcctgttgcacctctgtgatttggtctgtgtgcagccccctgccagtgatgttcactcacacagcctgtcactttgtaactgggaggccgtgagcccaggtgacagatgctgcaggtatacccagctctccccagctctaacgactcctcctctggtcagcaggttgatgggagtgcctcagtggggagggagttcatagcaaccactccctccatcaccacggagaccatatcgaccaccatggtaagttgaacccaggaggcttccctctctgaccagccccctgccccaccaaacagccagagaacaagctaacatcgcctggctgcttcaggaagttgtgagctgccctcgctgcatcaggcatgggacataagtcagctgtttattatctggggctttagttgccacaggacatagtcaggcctcagttttccaaagtgagtaatgtgggcgatggaatccccactgatagtgtcagttatctaggccatctcagccacagcagagagagagagaggatggtcttctttggttattggcacccacgaatctcatcttgcattgagatttcattggctcatctcacctccactctgaaggtgaggctggacccatcctggtggctgcacattgtctcatgccttagaccacttccttgccttggtcagtagatggcgtgtggtgaccctaagttggaaccaggatttttgggacctccctattgagggacctcatggttctgctacttatttgctgtctgacccatgaaggaaggcccttggcctgaggtgtcctcatctgcaaaatggcaataatccccattctgcagttcttaagagaccccggcaacactagatcccttcatgattaaacagaacagatagcatttggcacacaggttgtggttccagtcaatgtgctgagactcctgagtggataatctccgtggatgctcacagacactgtgaggtggatgctcttccctccacaacctttatagatgaggtaactgaagttcagagaggtaaagcgacttacccaaggtcacacaatcaataagtggtagtgccaggttatccccaggccttctgacaccaggagccccactttcaaccccagccactctgctctgcttccttaatcctgaccattgtgaacatcagccgcatggggctggggctgcggttgcagccactactcgggctagggaaggtagcagtgctggagccagagaagttgttttcaaatactgtttcttgccaacctcctgacatacacataggaaggtaattccatcaatctagactagccagcaggtaggttttgaatacacagaaattttaaaatcaataagtccaaactagttaccagcttgcacacctttccctggtcactcagttcctcctctcccctcagtccttcaccacgtgtcattgggatgcttgtagggctaaatttaaatccgttcatatggtgagcaggcacttataccattcatttactcatccatccatccatctattcattcatttgttccaaaaacatttattagtctgtactatctgcctggtatgggggatacagttgaagaaactatactgcctgctggaattcattcattcaaatgaccatcatgagcacctttaatgtgctgtgaccctgtatttaggttctgggcatacagcggagaacaaggcccagctgtcccacttcctggctggatgaccttgggcaagtcacccgaacctctccaaacctcagttttcacttctgtaaaatgggtgagggtagagggcagtaatagcatgacctcaaagggctgatgtgagggggaacgaaagcaatctgtgcaaagccctgagaacagtgcctggcgcataataagtggcctgaagatgtgagctgcagttacttctttcctgccttcatgggacagtgtaataatgctatcctaggggccaccaggaggacagctatggggtgacagctctgccaggaggagccaggaaaggctttccctaggcagggacatttgagtgagctatgcttgaaggataaattaaagtatggtcctgggggaaggcattctagacagtgggaaaagcaagtgcaaagggcagaagggaaggagtgcagcatttggggaaggaccagtggtcaagaaagccagatgtcaagcacacggaggaggagtcgggggggaagagctggaaaggaaggctaggccagagcttgatagacctcaaatgtcatataccaagttcaaacttctgtcctgcagacaatggggaatcacttaaattttttacattagggacatgatgtcatcagatatgtgtttctgtgttttagaaagattattctagcaacctctgtggaggagggacttgagcaaaaaattcttccctccttctctctctctccttccttccacaaatattgattgaacacccatgatgtgtatagttctgtaccagccactgtgaatccagcttgaagaagggaacatcccggggctctagggcccacatgccactgggagagacagagagagaaggcagggaaccagcttagatgctggtgcccaggctggggtggggctggagtgcaaggaggtggatgcagagaaggggtcagggttaagggatgcctggaggggggaaagcacaggatttggtcgttggtaggatgttcaggggacaagaggaaagatgagctcgtgacaccgttcactagccaatggttctcaaaatgtggttccaggaacctgttagcaaggcaggtcctttgggctcctccttagacctattgactcggaaactctagggtggggcccagcagtgtgtgtttttccaagccctccagctgatgcctctgaagttggagaactgctgatgtaaacagagtgatgggggaaagtgctctttagtgacaagcgtgtgttggaagtggaagaagcagtgaattcctttcgagatcggatgagtctgaggtgcctgtggaacatttccagggcaaaatgtctaggacacaactggttttaaaggcctagggtccaataaatatctgggctataggtgaagggataggggactttgacctccatgaggcagcagaagctgttgagtagccgaggtggcccagagagcgggtggcaagtgaggagagcctgaatgtggaggaagagagggctgagtttgccttggtcagggagaggaaccactcctcctggaggcaggtgacgggactggccaaggatacaggagaggaagggaggagcagagggtgcctcgttttgaatgactgatgtccctagtggtggcctctgtttttagtgtgaaggtggaggtgaggctttgccctgggaaagacagaacaatgagagaataagaggctttaagggagaacttcccagaatgatgctaggattcataggggttagtggctgttaaggggaaaggaagcattgagcccggaagctgcccttgggaagcctgctgctgggccacattctggaactgcaggtgcatctgggaacgtgccttgtggtgcagtaccaaggaaccaggctgctggcagcctcagcaggatgcaggtgtgggagcggcaggggaaagtcagcgagtttcttttctcacctgtcccttggtaggcagaagtccagatctagtgccatgcctggaccagaatcagaggtcaggccactgaggacctgcagaatggacacagttctgggcccctggacagacaaggctgagccctgagatggtgcagaaagtaggaggtagaagcaggcagctgggccctggcgccagatcgggggcagtaagtcaggggacaattccaggaagatctagcaattagaatttaaggtagggccaagagagctgtctgaagggaaagattcccaagggcagagtggcgtgcacagtgtgttggacttggagtcagacaacatggagttaagttccagctctaccactaacttgctgggagactgaactcttaagtttctcttgccctccagtttctcatctgtaaatcaggaatattaaaaataatgcccaactggtgttatgagaattaaacgagatgaggcatgtaacatccttaaaatgatgcctcgcacatagcaagcactcagaaagtcattattattattatattctaaatagccagcttatgcccctatatttatcctatgtattttggtttgcaaaaccttttctactccattagcttcataggttctgtgtgggattggggcaagggtccttttttacagatgaatctgtgaggcccatagagaggaagtggctctgccccaagtcacatggcttgaaggtggcagggcaggacacgagcctgaatctggcaactcctctgctagtgcttccggagaacaatgccatgtcttgatcactacagtgttcctaacgccagacagtctgtaaatgtttgttgaatgagcgagtgtgcaagtgtgcgagtgaacaaatgtgtgcctgagtgagcaagggatgaatgaggcggaactgaacgatgccttcagtcctttgcttctattatttctactcaaccttgtggtcgtgatagctacatggccacatgctccgcccatcctgggggcccacccggctgagagctggccatctgagcactattgtttccccaggagaacagtctcaagtccgggaagggggcagctgccatgatcccaggcccacagacggtggccacggaaatccgttctctttctccggtaagtgggcaaggccagctcaggctaggggactccacactgagaatatgggcatggacccatgtatggctggcaggaagtgcagcgttgagcccagaaggcacccttctaggtgcaaagccaggaaactggacccttttcagatgcccacagggctccctggtgcctgctagaatctcatgagtggccctccccaccgcccacacatgtaagtggggcattggtgacatgtgagggtaaagcggcccctcaccttggtggtgctgctgagggttcttttgcatctgccctccctactaaccaggaagagcaatggactaggaggccagaggcttggattctggacctgcctctgttggtgcctgcccagtgaccctgagtctgtcactgtagggtctctttcagctcttgcattctccaagtctgtggttctcattgtttagctccgcagagagcgtgcacctggctatgacaggatggggcatcaggagggctgtgtttccaccttggatccttttggtcattcttccatgatgccaggattcttaaattctagggtattgttaggattctgggcctcaggaatcttagcgtctaggaatctcagactccaggatttgagaatttgatgggtctagttttctgaagattctagtattcttgaattcttaatggctgaaagcatcttggcttcgaaacgtcaccttcacagagccctttaccccaccccgccctcacccctccagagcccactgtccttacctgacaccctgggtggggggtggttatattctgcagatcatcgggaaagatgtcctcaccagcacctacggcgccactgcggaaaccctctcaacctccaccaccacccatgtcaccaaagtgagtagcagcagggcgccccatgcccccagccgagctgcaggcgagaaggtcatgactgttgttctgcttcggcttcgccatctgtaaagtggacagagaaaacctgtagtgtttaccagcttctggaatactgtgcgctttgtcctgtgccacatgttgttctaggcacgggcccttcccacacggcgttgacagccaggctagggggaacaatactctcctctttgaagtaactgtgaaccatggcgtgtgcgccttgtagatggaaagtgctggaggaatctagacggggtgacatatgggaggccctgcaagagtcaggaagcatctcctggaagaagtagggactgagtagagtcttggaaagccaggcaggacacctgagggaggagaagacagatgcgggtgttctaagcaaagcagaagagggaagcagaaattgtgtgtttgcttatttgtttgttcactgagcagatgttagtgagtgtcaactttgtgttagcctctgtgccagggctgctggatgtagcagtaagtgaggcctgtttatgggacatgagaagcacatgtagggggtgtaactgggaaattaggttgcactgggggcagggaggtggaatatagagcaaataacaaataccaggacacatttgactctggaggatctgggcctcagggagattggaaagccatgaaggtttttagattggagagtaacccagtgaacataggtttaaggagagaatatcaggtccaccaggatgtgtagataggtgggagaaagaagagggagaagtatggagagagacggataataaataactcaggcctggtggggagggcctggaccagggtgtgagttagagctcaggcagcaagaggtaggggcaaaggagggaagccttcctgggtgacccagcaataaggacaagggctagttgggaggcaggcgggctgatgcgtccacacctatgtggccaggaggaaggcaggagggcgcctagccagggctggaggcctggagcagccaggttgatgagccatcagaggagaactctggtcagttgcactgggccttcatgcacggactgtcctggcctctgcctgcgcctctacaggattcagcactttctcacgtaccccacaaagaacccactctcagcaaaagcattactgagcaatgttgacttctctgaaagctttatgggaggttttacatcccacgcccacagcagacagctcaggaaactcttcttcccaaagtccctgccaactgggagccccctcttctttctatccactcctgactccagctgggattccccacagacaccaccctgctttaacatgccaaacaattaggtcctgcctcagttattacttctaaacttgtccaaaccccttgccttcagaaaacagcggaggtcataagtatcatcaatccaattttctcttgtagtattttttgaagttgcttaaggcagaaccttgtcaccattcacatttcattcatgtgttcattcaacaaatctgcattcagcactgccctggttagactgggtgagggagtgggggaggaggggatatagagatgaacaaaatacagaccctgccttcaagagctggcagcctggtgaggtgaacaaggccacagacatacataaggtcggcaccaggcagagaggtccagaactgtgagagagacagattcagtgctcaggcagtaccaaggcaggaagacagaagcattgccaaccagggtctgagaggcagcattggagctaggcttggaagacctagatgggatagtttggtagttttggggagtggtggcaaccaggcaagatctgcagttcaaagtccaaaatcagaaaagaaaaaatctgaggaagtcaggagagaaggtaactgctggttctcagccctgccctcgagagatgatttgggtaggtcccctcttgaggctgctgccccaacaggacccaagagtgacctcacctccctctccctctgcagactgtgaaaggagggttttctgagacaaggatcgagaagcgaatcatcattactggggatgaagatgtcgatcaagaccaggtatgggggtagcaaccgttcttcccagtgccactgcccagtcctcaatccctcctatgttgggttacccatggatggctatcctcatgggcagagaaggtgtccacttcttgctgaccctgttcagataagaaacccccaagagaggggcattggatgggagccagaaggagccagaagacctgagctctagtctctccctttagttgtttgactttgcccctctctgggcctcagtttttccagctgtgcactagagggcttgctgttcttcacagtctctctcgtcttggatagttcatggttccttcctttgctgttctttaccaccaggccctggctttggccatcaaggaggccaaactgcagcatcctgatatgctggtaaccaaagctgtcgtatacagagaaacagacccatccccagaggagagggacaagaagccacaggtaaggctcctgaggcccagcaaccatgagagagaggagggagcagtagcaagatcctctgagggccatttccatctgagaagccagtggcttgacccctagtgcagctttgaccctccccccatcagccttcctgatttgctgctcaaaggagagaggcacctccccgagatacaagtcggtggggagaagaaggaagactggttccttggtttctttggggtttcaggctccagatccagaaaaataaatccagaagtggttaaaaatttttttaaagggagggaaatggagagaggattgacagtggatattgaggtgggacagatggaggtcctcattatctccttgggcattgtctataaaccggaagtcagaaaaagtcctactaggcccagtgccacgttcctggccctgagtctctctctctatcacaagtcactgaatgttgttaaggggccatgatgaccagagcccttgatcccttttgtcttgcttgattgcaatttttatattttttgagatggagtcttgctctgtcacccaggctggagtgcagtggtacaatcttgactcactgcaacctctggctcctgggtttaagtgattctcttgcctcagcctcccgagcagctgggaccacaggcgcccgccactgcgcccagctaatattttgtatttttagtaaagacgtggtttcaccgtgttagccaggatagtctcgatcccctgacctcgggtgatctgcccgccttggcctcccaaagtgctgggattacaggcgtgagccaccgcacccagcctaatttttatattttcagtagagacggggttttaccttgttggccaggctggtatcaaactcctgtcctcaagtgatctgcctgcctcagcctcccaaagtgctgggattacaggcatgagccaccatgcctggcatgattgcattttgacttctgagacctgcaggagccaaaatcttagggactctaatattctcttgtttcactgtgggccatcaatgctttggtgaataagagaaataagatgatgttggggcagatagggcttttaagcaacctaaattaggggaggggttcttctgggccctctggaaatttaccagatcttatcagatcttaaagcaaaatcccatagacattgagttggataaaataagccaggcacagaaagtataaactgtatgattccattcgtagggagtccaaaagcaagcaaaactaatcgacaaggttgaaaatcagaatattcctgattttctatctgagaaaaaaattcttctgatttttctgttacttctgggatgcagtattcacaaggaagagggaagggccagaaaggaaccttctagggtactggaaatgtcactattttcaactgggtgggttacatgggtatatacatataaacacatttataaaattattctcccacttagagttgtgtacttcacacatttcatgggctctaccacaatgaaaaaaaatccatctcaaagaccccacaaatataattgctggtctcctttttgcccttttccttgaatgaatgaaaccagtcttttctagaaagatacgagaatgtttctcttcctttgattaccagaccccttaatgtcagaagaaaaagcactgaaacattttcctgctgctctgaaaggctgctaacctctggtctggactagggctgttcagcagaactttctgcagtgatggaagtgttctttctgtgctgtctgggatggtagtcactagccgcatgtggctattgaggacttgaaattggctagtctaaaaagaaatgtgctttaagggtgaaatacatgcaggattttgaaaatttaatataaaaaaagtaaataatctcaataatttttacattggttacatatttaaatgataagggatacatcaggttaggtaaaatgtactattaaaattaacttcatctggccaggcacggtggcttatgcctgtaatctcagcactttaggaggccaaagcaagtggatcacctgaggtcaggagtttgagatcagcctgaccaacgtggtgaaaccctgtctctactaaaatacaaaattaggagtgggggttggtgggtgcctgtagtcccagctactagggaggctgaggcaggagatttgccttaacctaggaggcggaggttgcagtgagctgagatggcactattgcacttcagcctgggcaacagagcgagactccgtctcaaaaataaaataaaattaaattaatttcacctgtttctttttaaactttttaatggaaactaaaattgagaaatttaattgtgaaattaaaattttctatttatctagaaatttttagaaaaatagaaatatatagaaaatttaggaagtgttatctagaaaatctattatctaggaaaaaaatttttttttttgagacggagtctcactctgtcacccaggctggagtgcagtggcacgatcttggcttactccagcctccacctcccggattcaagtgattctcgtgcctcagcctcccaagtagctgagactacaggcgtgtgctaccacacccaactaatttttgtatttttagtagagacggggtttcaccatatttgccatgctggcctcaaactcctgacctcaagtgatctgcccgactcggcctcccaaagtgctaggattacaggtgtgagccactgcacctggacctatctaggaaaattttaaattgcatatgtagttcacattctatttctattggacagcactggtctagaagtgtaggttggccatgggcggagcctacctcccaggcttcctcagaccttcatacaagtgattgtcattcctatcccctcagtttttcaatcattcttcctttattcctcccaaatctcagagtggtagagtgtaggccacttgctgagctgggtgtatcacctggggaagcctgtttaaaatacaggcactggagaaccctctccataaagtctgatttagaaagactggactgggacctgggacctgtattgcctgggaatcttcatttctgccttggtccttagggagtccgcgtgcagccaggtatagtagcattgatgcaaagaactctgtattgggaatccagggacctggctctaaagctgttccactgactggtgtgtgaccgtaggtccgtttcttcccgcttgaggactcggtttcctcacttgcaaaatgaagaggtggagcgagcccccttccaattacagtcctctggctatttgctttcctggggtatctgttgtgcttttctcatctcttctccattccctctctcacgcctcctcatctttcccagggcattcagaaccaggcccccaggctcccgccttcccatttccctagccattcagagccctcatcctggcctccacatcctgcccaccccgccgcgatgcagtctttcacatctgcccacctcactgctccctttgctgtctcattccctcctcctcgcctctctttagttctttctttgctgccattgccccacgcaccaccatgccccatctctctctcttctgggttgttctgtaaaggtcaccttgtttatgttgccctggcaagccagaagtttctctcccttgccttttctgcccacatgctttaccagtaattatggtcaagtagaacccaagtctgactcttaatacagtcagactcactaattctagaagaggtctcctctgaattcaaaaactcctttttaaagtgcttggaaacattggcttaatggatggatgcctcttggtaccccaaggaagagctctgtactcctgcagagtctcaagccctgccctttattagctgtgtgaccttttagcaaatcatttaaacttttcagcctatgattcctcgtcagccaaatggcaatgatcatcacagtaataacaatcgctataatttatggaaagcttaccctgtgccaggcaccaggctgtgcactcaacacaagtactgttacctgctcattcattttacaaatgaggaaactgagggtcagagatgttaagtggcttgctcacagtcatgaagctgtgaacatgatggattgattagagagtgaaacccaatctgttagactccaaaacccaatggtcttgaccttttcaccacacccacttttcataacgtctgtctcctagggctaccaagatcatccatgcagcatggtagttagcacactgcctaccacatcgcgagtgcttaataaaagctcattatgactactattaccattaacttgaaataggctaacaaaatgctgcacgcagggactgtgctgtgctgtaataaaccaagaagaataaatcataacactgtattgtttagatgtctttggtacttctgaagtgtctatgggcttacgaagacatcccacatacccagaataatgattacactgacttataggacagccacttcattaattgatgcacaaacttaaagtgcagcctgttactgtaaggaaaaaccaaaccaaaccaaaccaaaaccaatgcccagttaggatgtagtaattttgctactgagtaatattctttgagtagtattctttctactcaattttgaccaggggccaggcacagtggctcacacttgtaatcccagcactttgggaggctgaagcaggaggattacttgagcccaggggttcaagaccagcctggccatcataatgagaccttcgtttctataaaaaatgtaaaagattaactgggtgtggtggctggcacctgtagtcccagctacttgggaagttgaagcgggaggattgcttgagtccaggaggtccaggctgcaatgagctatgatcgcgccactgcactccagcctggcaatagagcaagaccctgtaaaaaacaaaaaacaaaaaacgaaacgaaggaaggaaggaatagatggatacaactaggttttggagctagaaacaccttggtagctgtgtgcccagaggaacctctctgacctcagtttcctcatctgcaaaatgtcattaatgtatacattggagttgctgtaataactaaacaacacctgtgatatactggatctgtgtcttgcctacagaaggggctcagcaaggtgaacctgcttccttgtccctctgaggtttttccatgtttagaggttgatgagagtactgagaaagtcagatcgtaattctccaccaccagcctggtgcctgaggccctgtctccatgagggtgtttgtcttactggtcttcatcttctgttccttctgcaaatcctccagaaacatctgtccctgcttcagttaactctgtcttccttcttaaagttcttccttcttgaagttcttgctatgagcgtggaaagtcactcatgtcacacagaaccttttcccttctctccctgcaaccttgcaggtcagacgtctggtttctgctccatcttctcccactggcccacctccttcagagaggacctgtctcccaaacaccaccagcaagagggcagcacttgcctagcttcctaaccttccaaaatttaatgggaaaaaattgacctgttccaaaacaggaaccttgggttttagtcttggttttgccaacttactaagcctgaagcctctgggcctcggttttcctatgtgtcaaatgagccaagaaagatccattttctgtgattccgttagcactcgactgcatgcaagtagcagaaatgatgtttcatccattaaatggttttgagtagttgctatgtgccaggcacagtgttgaacactggaaagacaagagttaaaagatagcccttaccctcaaggagatcagagtagtgtgtggttaaattaacaacagcaacaatcatcataataagaacagccagtatttattcagcacttactatatgctgggcccttgcttcagttcctccctataatgggaggcagaacctattttacggaggaagcaattgaggcttaaagaagttaagaaacttgccaggcactgtggcgtgcacctgtaatcccagctacttgggaggctgaggcagaaggatcacttgcagccaggaattcaaggctgtaatgtgcattgattgtgcctgtgaatagctattgcactccagcctgagcaacatagtaagactcgtctgttaaaaactgtttaaagtaaaggaagttaagaaactcacccaagattacagagctagcaggcccatagagtgggatttgaactcagggagtctgatttcagagcctgctcctttaaacactgagttttggagccaaacctggaatccagacttcatttctttatttaaacactgctgtctgtggtttaatctccaggacacagcaagcccacggacaacagaaaggaaaaccaaatgaaaaaagaacatctgcaatcgtgactaaacatttcttagagctgacaagataggaagaaaaagtaaaatgatgatgatcttagcttctcggtgttaaaggacattttaacacattgtcaggccaaagtaaaagattaccacctccctggaaacaagcgagcaaacacacatgggctctggaatccaacagatgtgggttcggttctctgctgccacacacaagctgcgtggccttggagtgcaatagctactcacaggcatgatgattacacattacagccttgagtttctcacctcaagagatccttccacctcagcctcccaagtagctgggattacaggtgcaagtcactctaccttgctgagtcacaataaagggcatatggtaaagggtagcaaaaacaacctcttgccatgtattttaaaacaagtgacagaagttactaatttttcttgtcctcttccttcctttccccccactccccaccccccattctaccccatgcctctggcttccaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcggaacctgaggagccacctgagccagctttatatttcaaccatggctggcccatctgagagcatctccccactctcgccaacctatcggggcatagcccagggatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttttttgtttctcatcctctctgtgccacctctccacccaggaggccatgtagcatagtggaaaaagtccctgagggcggttaggagttctgggtgaccatcctggctcagctcctaactcaccatgtgacatcaggctatccccattccccctcttgggcctcagtttcccgacttgcaaaataagcagaaagaaccagatgctctccagggtctttttctactttgctatctcatgggtcttcattttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccatacttccttggcacctctcctctctctctctctctctctctctctctctctctctctcactgtctctctctgactttggccactggtacaagttggcactgtgggaggggctaaaactgaagtggagacatcccaacttagaacatgtttatgcaacaaatatttggaactcaaggtggtccaggccttgggtgactctccaggcacaacacaaacaagacaaaagtccctgcccttcatgaacccacaggctagtggaggaaacagatgccaacacaggcaaacagtccgttacagagcactcagcactaggaaggaaatacaccgggagaagggaaggagggtcactgaaggagaccactttaaatacagtggccaggtaaggcctccctgaggaggcgatctgtgagctgaatgaaaagaaggatcaatcaacaaaggcgaggaactttggtgcacattctaggagagggaacagtaagcatacaggccccaggacgtggaggggcttattgagcggagaaacagcatggtccctcctcctgaaagaagagtacctacattggagtctctcttcctgtaacccccctacatgggagcctagtgggaaaaaatacagcaatcctcaacttcggcctttgcccagaacctctatatatgttcccatatcctcataccacctgtcccattattcacttatttttctttaaattgactcaggtcaagtgcagtggctcacgcctgtaatcccagcactttgagaggctgaggcaggcagattacctgaggtcaggagttcaagaccagcctggcccacatagtgaaatcccatctctactaaaaatacaaaaaattagccgggtgtggtggtgcacacctgtaatcccagctactcgggaggctgaggcgggagaatcgcttgaacccaggaggcggaggttgcagtgagccgagatcgtgctactgcactccagcctgggtgacagagagagactccgtctcaaaaaaataataaaataaaataactaactaaataaattgactcacgttaaaagcaaatgcatttaaaaaggaaactatattacttccacaaatgaaaagcttatgttatttgccaagaaaggaggtcttcataaaataaatgcaaaaatattaaaattaacaaccacaatgcacttaaaacctaaactcatcccttggaccacctgaggtgcacacaccacactttccttttattccaccaagcaactcacctcagcccacctttattgctgcaaatctcaccagcgagtcttttccatgtgtatgtatttttccagagttggtcatcttgtacatacttttgtaaatactttaaaatatatatatgtacatatatgtatatatatgtacatatatatctatatacacgtatatatatcctgagcatttccgtatactttcaaatactaaatacttattttctttggaaaggtaattcattaaatgatacaaagactatgcagtgaaaagtgattcttcagccttctccagatttctgtctcttgtcagaggcaattgctgcgaggaacattatgaatccttctctgaattttccctataggtctcctttagcaatctgttatccctagggttctggaataggacttggtttacaaacaatgggtcttcatatgattcctcaggaccccatacaccctgatccatatttctgtctcccataaaggaccatcctgactcggcttttgtcgaataatcaaaggtaagttcacccagattagtgtttttcaactgcattgagagtggggaaatgacccctcctcctttacccccaacccccgccccggggacatttagcaatggttgtcacaactgaggggtgctactagctctagtgggtagacgccagggttgctgctaaacatcctacaatgcacaggacagccacatacaacaaatacttatctggccccaaatgtcaatagtgccaaggttgagaaattctgatctaaatggacatgtgacccacaaggtgggactcctaggccaccatttacagcttctacaaccagtgttcagtgtcctggagtctctgaaaagacggtgagcccaactgaaacagggagctttgagaccagaccatagagctcagcacttaagactgggagtggggaggggtggagagggagctgagcttcttcatgcaggagatgaaacttgacaggacaggctgagattggtaagcatgactgtgactgatggaggctgtctctggttaatcctgcagcagctcattgtgattaaccatgactgcagggcccggtctagtctgcaacccactaagagataaattttgaccgagacagattggcgtgtccagctgtcactgaggaaatgtgacagacaagctaaggagcagcagcacaagagataagaacagacagcccttggtttgcattctagctctgccattctctggctgtgtaacatctctttgaacctcagttttctcttctgcaaattgggaatacacataccttacaagggttagtgcaaggattataaatacccaagtgggccgggcacggtggctcatgcctgtaatcccagcactttgagaggccaaggtgggcagatcacctgaggtcaggagttcgaaaccagcctggccaacaagatgaaaccccgtctctactaaaaatacaaaaattagccaggcacggtggtgggcgcctgtaatcccagctacttgggaggctgaggcaggagaatggcttgaacccaggaggtggaggttgcagtgagccgagatagcgccattgcactccagcctgggtgacagagtgagattgcgtctcaaaaaaagaaatacccaagtggcctgccctaaaatcacataagccaattcttggcaataaatcacttaatatagatctcctactggctctgtatctttggtggaaccctgattaatagtgcagggttagacccacaaatagttatttattaataccaaattatcatcattattaattaaatgcataatatatgtactcagctgagcttttgtgcctggctttgtgctcggttccagggaaacagtgaggaacaagacaggcagattccttccctagtgcgttgatagcctgactgagatgttaggacttggcctgcaggaaggacacggggtgataatggccagagggactgaggtggcgaccgctgctgctgcagcagcggaggctgacgctggttctctctgggctggtggctgggtttctgaggctctccccgagggctgagtgtgactggaagctgagacactgtgaccgggatagagactggctgacaaagacagtgaccgagcgcctgactggctacttctgaatagtagccactggtacaagccttggctgtgctttagtgaccatgactgcttgagcccaaagtaagatggctggtggctgtgtttctggacggggatataaaatgcataggttaatgaaagttgttcacaattcagaagctaaaacgagaaactaagaataacaaaaggcaaccttgcatccggcggaacctgcaggcacgggccattcttcccgcgacccagggctctgccggaccgcttcccccgtcgctccagtcagacgccaaagctggagaacttccggtgcgtttccgctgtaccggaacgtggggcgaggcggtgagtgtggcctcctggcctctttttcctttcctgattccttgtgtatgtgtggctgggccgcccctcttctcggctcagagtcacggagtgccttgaactaggcccacctcgccggggcggctggttctctgtttgtgggacgctggtgtctctggaggcccttcctgagaagccgtcgccagagttacgtcgcggttttcttaactttagagcctgggggccggagaccctgattgcactcgacctggctctgccctactctctgcgtgacttccagtaaggtctttccccgaactgaggctttgtttctcgtttacaaaatggatatcatacttgtattaaataaatgtttactaagcgttgaatctgtgctagggatacagcaggactcaagtctcgtggcgatgacagccttcaatcaaacatccaaaactgcagttgtgatcattgagacggaaaggtacaaggcaccccagattatatcacaggagacctgacctagccccagggcaaggaacctttactgaggaggtgaatattgagctgagatcagaaaaaaggatttgacaaagtggggagggaagagttttctatatggagacagcctccaatttcaggttctgaaagaggccgttgtggctggaacagagagcttgtgggggaccattgtgtgacacaagctaaaggggttgccaggagtcagaccgtgcaggctttgtaggtaataggaagaattctggtttttcaagaaccatatgggaaaccactcagaagctgacatgggtggtgttgtgattagattggcattttgaaaaggttactgctgttgaatggagaatgggttgaggagcaagcactctgagtgagggacgatggtagcttggattagggaggtggtggagagaagtggatggatgtgactttaggtgttccaggactgtgaggaactcacagagctgtcagtgacaggggctggtagactgcagagttctatgcatatttaataaacgttttcctagcatctcctctgtgctaggccctgtgccagctgctggagatatagtgaatagaattacagactggtggaattagcatgaaagaaacgtcattatcaaggaggagcacacagatgtcacaagggaaaatggctaattgatgagctgttattgtaaatggaatatctgttcattcagcaaatattaaatactttctgaattcaggattacaaataggaagatgatacgtattattattattattattattattattattattattattattattattttgagacggaattcgctcagacccccaggctggagtgcagtggtgtgatctcagctcactgcaacctctgcctcccaggttcaagcaattcttctgcctcagcttctcaagtagctgggactactggcgcacaccaccatgcgcggctaattttttttgtatttttagtagagatggggtttcacagtattggccaggctggtctcaaactcctgacctcattatccatccgcctcggcctcccaaagtgctgtgattacaggcgtgagccaccacgcccggcctgttgatacgaattatttagagcagagtctttcaaacttttatgactgtgacctacagtaacgaatacattttatggcacaaccaagtatacacacaaacacacaaagctccagaaaacagtacttagctttactactcatgatgtattgtgatatttcaaaaattctgttattttcgtttaaaaaataatgctggttgagaccttcacattgatttcctaatccactaatggattgtgacttgcagtttggtgaaacacaaagtgctgattcagggtaagagtcatttgtggtggttttgaggtaacaatgataaaatgtgctcttatttttggaaaaggattggtcttcctttctgcactgctttatttaaagtaaaaagggtaaacagggccaggcatggtggctcacacctgttatctcagcactttgggaggccgaggcgggcagatcactgaggtcaggagttccagactagcctaggccacatggtgagaccctctctgtactaaaaatacaaaacttagccaggtgtggtggcacacaccggtagtctcagctgcttgggaggctgaggcacaagaattgcttgaacccgggaggtggacgatgtagtgagccgagatcacgccactgcactccagctggggtgacagagcgagaccctgtctcaaaaaaaaaaaaaaaaaaagtaaacaattaaacaggcagctcgtttttctgtgtgtgaaattttgacgtcttggctagattggaattgcctagagggcagtgactgtcttaatctgtgatgttttttgggggcctggcaaagatcctggcacaatgcaggcactcagtgagtatttgttaaattagtcaggtaggtatcttaggactagaaggttgcataatggtttgtttacatttgttcatgttggtaccattcttgccgatatcccagaggcaatgtctgggatattcagaagtaggtaaaataagtgtactaagctctttctcttctggccagctttctcttcctaggctagctttaccacctgaattcattctggatgaatggtccagagccaccactgattgtgggctctttgggaagttgtttcactccctggagtttaggttttttatgagtgaaagaagaggggagatttgtggtaggaaagctctctagaccctgaacaaactttagatgctgagcctccacttgctaccgtctgtccatttctgggccttccctgaggcttatgggaaactggatatgtacttgatttaatctttccaaatcttttgggatagttttttggcagaattgtagttttaaatgatgtaggcatatagtttagagtgacctgtccaggcattttccaccctcaccctctgttgtgagaaagagatctgagaagatattaagaatggacggtggacagaacactggcctgcaggcagggtatccagattctaatttgggtcctggtatgaccatgagcatgtcacttttctttcactggtatcttatagctgtgaagtgagtgtccttgcatgttaagccaaaacacaaaaatcctttcctttaatcctcgtttttctcatctgtaaactcaatgcagggttgtcatgaggattaagggaaataattatgtcaggggtctaactcaatatctggcacatacagaatgcttagcaaatgaagcatctttcccccacgttctgattaactctggtttctttctttctcagctgttcatcaaagaaaaagggttcttttggtcacccaccactggccccatggctgccgtgcagatggatcctgagctagccaagcgcctcttctttgaaggggccactgtggtcatcctgaacatgcccaagggaacagagtttgggattgactataactcctgggaggtcgggcccaagttccggggcgtgaagatgatccctccaggcatccacttcctccactacagctctgtggacaaggctaatccgaaggaagtaggccctcgtatgggtttcttccttagcctgcaccagcgggggctgacagtgctgcgctggagcacactcagggaagaggtagacctgtccccagccccagagtctgaggtggaggccatgagggccaacctccaggagctggaccagttcctggggccttacccatatgccaccctgaagaagtggatctcactcaccaacttcatcagcgaagccacagtggagaagctacagcccgagaatcgacagatctgtgccttttccgatgtgctacctgtgctctccatgaagcacaccaaggaccgcgtggggcagaatctaccccgctgtggcattgagtgcaaaagctaccaagagggcctggcccggctaccagagatgaagcccagagccgggacagagatccgcttctcagagctgcccacgcagatgttcccagagggtgccacgccagctgagataaccaagcacagcatggacctgagctatgccctggagactgtgctcaacaagcagttccccagcagcccccaggatgtgcttggtgagaaggaacaaggctctttgggagtgggccaaggggaggatattagcagaggtgttttggaatagggagtacatcttgtgttagtccagcagcaactaaacctggctaggaggctgaagatacaggtgtgtctttacccttagccctggagatttcgatttgagagatctggagtggggcttccgcagtttctatctgtctaataaacaaacatcctaggtgaacctggtgcagataatcttctgtttgggaaccactgatagagcccagtcctacagaaggaaaagatttggcccactgagtggctgaactgagacgagaacccaggactcttggtttctgggccagacctgtgttcgttgtagcctctcacctgcctgctcagtttgctcctgaccctcaagatgttggtctctcaactggcttagaacaggacagtgattttttttttaatcattacagtttttattgttaccttcccttttattacaaaaatgatagataataatcataaaagaaaaacaaaatttacttcaaatctcactacttagaaataaccatttaaacagtttggtatatttacgttcctttttttctgtgtatttctatgtatttcatttcaatgtcttctctgtttatttctatgtacttcctctcagtcttaaaaattcagtatatgtgtctgtatatatatgagtttttataaaaacaggattgaagtatattattactttgtaatctgccttaatataaatgttttttcatgtcactaacagtcacttttttagtggctgtttcatgttccatagttattggaccagttctctgttatggaccattgagatgctccctgttttctctattgtatcatcaagtggccgggtgtggtgactcacacctgtaatcccagcactttgggaggctgaggccggtggggatcacctgaggttaggagttcgagaccagcctggccaacatggtgaaaccccatctgtactaaaaatacaaaattagctgggtggtgtgcacctgtagtcccagctactctggaggctgaggcaggagaatcacttgaacccaggaggcagaggtcgcagtgaaccaagacctcgccattgcactccagcctgggcaacaagagccgtctcaaaaatatatatacatatatcatctagtgaacattctcgtgtgtacttacacatacatttagggatagaattgctgggtcagactgtgcatgttgccaggagaaggtttttgcatccttgctggctggtaggaacctgttgcccatcacctttgacagcattgggcatgacagtttaacaaaggcctcttccaattggatagctgaaaaatggcaccttgtttatatttctttatttcttaaatactagtgacagcaaatatgtgtcacattttgaacagctatttttatatatatttataaattttccaggtaatttgcatattttcttgttggaagttcagtgagaaatttgaatgtaggacttcttttttttttttttttttttttgagacagggtttcgctgtgtcgcccagggtggagtacagtcagtcacacaatcatgtcttactgccacctcaacctctcgggcccaagtgatccttctgcctcggcttcccaaagtgctgggattactgtgcctagacaggactttttatatcattggctcagctaatgatataacctatattttaacaggtacatcttttgttgttgttgttgttgttgttgttgttgttgttgttgttgttgagacggagtcttgctctgtcgcccaggctggagtgcagtggtgtgagttcggctcactgcaagctccgcctcccgggttcacgccattctcctgcctcagcctcctgagtagctgggactacaggcgcccgccaccacgcccggctaattttgttttgtatttttagtagagacagggtttcaccatgttggccaggatggtctcgatctcctgacctcatgatccacctgcctcagcctcccaaagtgctggaattacaggcgtgagccaccgcacccagcctttaacaggtacatcttaatgcattagtattttcgtataataagtaacttttaaaagtctggcttaaaaatgaatagaaatcctgtctttctacctcttaaacatttcaattcttcaaaatatatcttgcgaaaaggtctgttacaggaataactttgttggtttttttttttttttttttttgagacaaggtctcactctgtgacatgggctggagtacagtggcatgatcacaactcactgcagcctcaacctcctgggctcaactgagcctcccacctcagcctcccaagtaggtgggacttcaggtgtgtgccaccacgcccagctaattatttttggttgagatagggtctccctgtgttgcccaagcttgtctcaaactcctgaactcaagcaatcctcctccactgacctctcaaagggctaggactatccctgccaccgcacctgtccagggataattttgaatctacatcacacctctttgaaaaatataatttaattttagataaagtcagaaatgcacaaatttaataaatgtcctaaacgcaaataataggctaatatttagtttcacaaaccaagtaaagccagctgaagaagcaaatcattaacctatattatacaaagaaaatttgactatatttgaaaatattggtcagaaatccaaaatttctaaaccaggtagctattcacacaaatcaaacttagttccgtatgcttaggaacagggagctagtttttccaggtctctggaggtggcacagatcaaacgccatgcatttaaagaggtatttggtgttgagtacatctcttctttttatggcccacatgtatgtatacctcattaaatttccagccacctttgaagtagagagaatgcctgtgatgaggagcagtattctgtggtaaccagagacccagttacttgcccagggacagtggtgtctggatcatcaggtctctgtttgagatgggcatctgatagaaattgggaacataatattttttgagtgctactttgtgccaggtcttattctaaatgctatacatgtactatatccattcatgtaatctttgctacaaccctcaaataaggaaattgaggccttaatagattgagtaacttgcccaaggtcacacagctgctaagtggcagagctaagatttgaagctaggcagtttggctccagagcccatgctcttagccaccaagctgctcatagagattaaatcacagagccctgtggttaagcaaacaaaaataatctgcctggcaggctgaccctggaataagtactcatgaatttttcttttgtgggaggttccagaactgttcccacccaatggagaatctgttttatctttccgttgcccacattgtgaagcattagatgtgtggccttgggcaagcccttgaccttatctatgaaatgaggcaaataccatcttcctgatcgccttgtggagttgggctgagggttacatggtatagtgcagtatttcctgaccctggagcagaccatccacattagaatcacctggggagcttgttagagctacagatacgaaggccccatcatctctcctccaccagaacctctgagggtgaagcttgggtagctttacttttaacagactctcagtgattctgatgggcagccaggtttgaaatccacttggcataatatccatgaacacattttgtaaacttaaaatgccaggcaaatactgggaatacctcttctctagcagtctgattttatagaaatccaaagccacaggttggtttcccatggcttgaattcatagcggttcagcagacatctattgagtacctgttaggtgcaaaatctcctgccaggctctgcaggagtgacaaggataaaagctcatctgttgctgaggtccagtggaattcatggccttgtgaatagtgatggagagtgtcagctggtcctcctctccctcagaatcacttctcctctctgcacctttcaggtgaactccagtttgcttttgtgtgcttcctgctggggaatgtgtacgaggcatttgagcattggaagcggctcctgaacctcctgtgccggtcagaagcagccatgatgaagcaccacaccctctacatcaacctcatctccatcctgtaccaccagcttggtgagatccccgctgacttcttcgtagacattgtctcccaagacaacttcctcaccagcaccttacaggtgagcagtctttctgactgagctgatgcacatgtgggtcagaattgaggcaacagtatgtgttttgtttctcgctattcttccatgaccccaaaatttttaaatttcagtttcctagtcttgggatatttcctgcttttctctctcttactcaattgtaagtgcctctatgccagaaattttctctctgtaccaccctctccctacacctcgtccccagagtgcctaacactggggtacttggatttgaattcctcccactgctttggtttactcagcttaaaacagcgtttctttctccctgtagccatgaattgctacaacccagtaaagcagaattttgaagtttgttattcccagtgaaacatctgcagctccttagatctcatttaagcattaaaataactttgatttcctgttcaaacaaaatgtgccagtttctgcagagattctatgacagaaaaagtgaaatttgcttttaacttggcaattaaattttcattatgagtggtaattaggaaagaagcttcaaacaacttacaatcttcatcctatgctatttcctccctttgcaaacagattagtcctttatgtacttgggacagcctctgtcactcacattgtgtaactttctcaagaatagaagaggcagaagctgccactgtcagtttccatactttccctcccatgagcttctttcttctccctgtgtgtaatacccccatgaggcctgctccatataaggcagcctttcaccaaccttccaatcccactcggggtaacagaagggacgagcattcgttaaatattggggctgggcgtggtggttcatgactgtaatcccaacactttgggaggtgaaggcaggaggatcacttgagcccaggaattaaagaccagcttgggcaatatagtgagaccccgtctctccaaaaattaaaaaattggccaggtatggtcatgtgcacctgtagtcctagccacttgggaggctgagacaggaggatcacttagcccaggagtttgaggctatagtgagcaatgattatgatcgtgccactgcactccagcctgggcaacagagtgagaccctgttcactcattgaatccctttggagccttgtaagatgggggtattattcccattttacaaatgggaacacttgagaatggttaaatcacttacttgaagtcatacagctggcaggtggaggtcaggatttgtacccaggcctgagtcttggtttcctgcctgtgcttatgcccttgtgtagtgaacacagtgtgaatcccccagaaaggattcttgattgacatcagtgaagacttcatcgaggtcctgtttctcagaggtacagaacgcttttctaaagccaacctactgttggatgagtccctgtgagcaggcatctgacttaaagctggcagttgaaggacctgtgtaaaccatggcaatgagtcagtcaagcgcatgatttgagcctggtctgttccactcagaagagctataaaactgtccttttactggttcttcatataacagagaaattaaacccctttgtccttcctctgtggggaaaattttccccaaaggtactggttatgggttgtgaggcagtgtgaggaggcattagcctgctaacttgcctctggcagtggctgcttccctcctgatgcacgttgatgcgtcgcacagacacaggagggccacggtgttgctggctgtccagaccattgttagcacaaccagcagctgagctctataattgccaggctttgttgccagcaatgatttacaaagcagaaagtgcccagctggattgctagatgcccaggtgggttgtgcaaagctgatggttggaaacattcagtctttgaacttttcaccaagaaaattcgatgtcattatttggaaaaatccagggcatgtgccaaaacaaaacaaaacaaaacaaaaaacacatgtctttgagcattcttcatatataacattctactgaaagtgttgaggaatatatatacatgtgagttagccagggttcctgccctcaagggatttgttcattgatttagcaggtaattgctgagcatctgctgtatagaagactctgttctagaactgggaatatagctgtgagcaagacagagtcattgtcttgactcttgtaatttgagaaagttaacagaaagttaactagccaagtaactccagatagcagactcttgtattttgagaaagttaacagaaagttaactaaccaaatagcagtaagcaggtagcagtaagtgttttagaaggcagtcctgccctagtaccatttccctagccccggccttttggtctcacctagactgcatcggagtttaccagcctccgtgcttaccagttaccccatctctctcccacactgccacctgaggtgctgctccataatgcagctgtgatcctgcttctctgtggctcctcattgcgtggaaaattaaaagcctaaacattggtcgcaaaggccattctgatctggcttcttatcctgttctccagcttctctttcctctccgttttcccccatcaactccagcaacagtggtctctttgcaggttcctggacaggttatgctgtttcatgctttttaaaaaaaaaaattgttgtaaaaaacagctggtccatggtggctcacgcctgtgatctcagcactttgggaggccgaggctggaggatcacttgaggtcaggagttagagaccagcctggccaacatggtgaaacccccatgtctactaaaaatacaaaaattagccaggcatggtggtgggcgcctctagtcccagctactcaggaggctgaggcaggagaatctcttgaactggggaagcagaggttgcagtgattcgagattgcaccactacactccagcctgggcaaaaacagtgagactttgtctcaaaaaaaaataataaaaataaaattgtggtaaaaaaaaacacaatttaacatatatgccctcttaacagattttcagtgttcagtacagtattaaccataagcatcatgccatccagcagatctctagaacttcttcatcctgcataattgaaactttatacccatgtttcataccttcttgccggaacctgattttccctctccctggtacatatttgctcattctacaacatgccctcaaggcatccctctctgtcaagccatccctcctctctctgtctcaatctctgtctctctttcactctcccctttccctactcttagcttactttgaacttgtcgctattatattgcatgagatgtgcttgctgaaactaatatattgtctgcctgactcccgcactgagtcatgggctccttttacacgaggcctattttttgttcatctggttatcttcttcttcttcttttttttttttttttgagacatagtcttggtctgtaacccaggctggagtacaatggcgcgatctcggctcactgcaacctctgcctcccgggttcaagtgattctctggcctcagcctcccaagtagctgggattacaggtgtgcaccaccacgccaacctaatttttttgtatttttagtagagatgaggtttcgccatgttggccaggctggtctcgaactcctgacttcaggtgatccacccaactcacatctggttatcatcaatatgttgtcaaggcctaacatttatgtcatttggtgttattgggtgtttttagatggatagagttcataattcttgtgacaatgtaaatatcataggtataaacagtggagtctgatcaaagggcgttaggagcaccaaagagggagtggttaattctgactggggttgagatttgaggctttatgcaagggtggaaggtgggggcatttgaccatgcacttgagggatgactgagatttcaaaaggcacaatgtggagaaggatattgtaaaactttttttttttttttaatggagagtcacgttgatgccatgttggcagtgagagtccagttctccacacagaggcattcactcagggcatttgtgactgaatgaatcagcccataaaagccttcctcagccagccgcctgccctcccaggtagtcaagtaagtggaactggctgtcttacttaggagcttaaatggctactacccatggagagggactggtgtttgtgtgtgtgagcacttaaagacagccacattagcatggataaaatcagccgcgtaatggaattctcttagccattaattttttttcaactttcccatgtgaggcccttttgaatagaagccactggtttttacaaatcccttggatttcacttgaataaaagggatttgttttacaaaaatagatgcagttttttcttttatttaaagcaacgtaagtcaccataattcatttaaaaccaatgaaaggataatctgaatttaatgatatgttagaaagtgagttatgtacaaaataaggatttttattgttgattacgtagtacttaggcatatagtcatctaacctgtttttaaaaatacttctagttacaataggccgtatatgctttccaacttcctttgttgctagtattctaaatgtgtgttcatctttaactcttgagggaaaacaccaactctgacgatgaggtctatggtatttttatcacgatgcccactatgataaatttgcctgcctactcctacacctcttgccattagctatctcttttgcatgcttagtctcattgagccctcacaacagtgctagaagctaggtctctaatcccattatatagatgaggaagcaggctcaggaaggtcacataatttgctcaaaatcaacagagctagtgaaaggcaaggctgagctttacattctaaagcctatggtgggctcctgtatatgattagagccccagatgaaacatcccagatttttcaaactgacctcaggtgatctcatttatgctgctttttaccttcctggtcatcattgtgaaacaatagtcttgcttttaacaccactttcttctgctgcaagtggaaacaaaatcttctacctattgctagtttcattctaagttgaataattatttgggaattgaaaaaattaggaaatgtcatctttttggtctagctaaaaaaataggataagatagtgacatagctacctaccttgatattttgaatttctcgaggtgacctaactgaactcaatttatttaacttaggtttaagaaaagctttcacatgtgtgactaaagtaatttagaatttcataatacacagattaaatgattaaagtgttcatgctttattttgtgtttgaagaaaaacacccagtaggtgtgctttttgttttagataaatgcatttgtttgcaaaatattatcctatttcaaaagtattttttaaatattcagtattgatatgctgagattaaggtgatttatgtcccagtgacgttaaaaagtgttgacttgattttgttttagtgaataaaataactagaccactgttaagtttcctgaagaaggcgtaaaattaatctgaaaataaaagaatcagaataagttattgcttggaaactaagtactatttagacatcttcatttctgaattgtgaggagtttttacaaataccaagtttgtgaaactgtggtcaaaaatagaccaggaaatgccagggggtaggggtgaaggaagggtttgactgctaaggggccgcacaagggagctgtttggtgtgatgggatggctccatgtcctgattggggtgacggttacacaaatttatacgcaccttcaaactcagaactggataccaaaagcaaagcaaacactgtgaacatgtatcatatggtggttgcatgggggtatatatatatttgtccagattaactaagcatttaaaattgatgaatttactaatctgggcaacatagtgagaacctgactctacaaaaaattaagaagaaaaaaaaaataccaggcgtggtggctcatgcctctaatcccagcactttgggaagacaaggtgcgtggatcacttgagcccaggtgttccagaccagcctgggcaacatggcgaaaccctgtctctacaaaaaatacaaaatttagctaggcatggtggcatgtacctatagtctcaactactgaggaggcctagatgtgtggatcacttgagcacagaggttaaggctgcagtaagctgtgatcacatcactgtgctccagcctaggtgacagagtgagaccctatctcaaaaaaaaaaaaaaattatctaggtattcgtggcatgtacctgtagtcctagctacttgggatgccgaggcaagagaatcccttgagcccaggagttcaaggctgcagtgagatatgatcatgccactgcacttcagcatgggcaacagtgagatcccgtctctaaaaaataaataaaataaaatgaataaaattaattgtgtgtaagttataccacaataaggttgatttttttttttaagtcaacccagactatgccctgtgtcctggaggctgcagaagggacagtttcagaagcaccttggttccctacaaggcagtgctaaaaataaatatcagggatggattaagcctctgtcaagacaaaaggtctgggcaggcaaaggatgaagccgagatgcctctgctttgacaggactctgctcagcatttgtcactgcgtgttgccgcatgcctagtgtcttacctctgcagtgggaatagtaagttcctgtcctgcctcccaggctgtggtaaagatcaagttggtgagttctttaaaaaggacgaagcactttttaaattagaaaacgtatttgttagactgaaggtgtctgttttacctgcctctagtggaatttattcccaggcaatgtttgagaggtgctttgggaggatgggtgatgagcgtgagcccagtttgttccagcctgtcactcctggccattgccaagtgcagggcagtccctgggtctcaataggtcattcggtgagcaccctttgggccctaactctatacctggccctgggtgatatgctttgtggcacacattgataattgggacacaatccccacttttagagggtgcaaatcactgtgatacaagcacagtgtgaggaatgccatgagggaggctcgggcacagtgctggggaacaggggtctgagcagttcatgtcacaaggaggtttcttgagagccatggcattcaggggcctggtaaagaagctgccttctccttaggatgagcctttctttctccccagcatcaccatatcactattgaacagctatttggtgctaggcactgtacaaaagtgaaccccaaattgagtctgtggttgtcttcattcttctgttcattaaacatctaatgggtcctttttgtgtgtcgggcgctgtgccgagagtggagcacggtgtgaaagagccgctgctgtgaggttgctccgtgtctggtggacaagatcaacagcaaatggcctgttagcttactgagactgatcaaggtagccctggggctgagggaacgcagaggagcacctactccatccttggtctggaagagatcctcaaggaggtgatgtttgagctgagcctgagtctttaggagaaattcataggtgaaggaggagaaagcaggagatggaaaggtgttaagagcagagggaaaagcgtgtgtgcagagaggcgcagaggaagcagtggcacatgtttgggcagctgctcagtggctggagagcagggactgtggagagtcatccaattcccatgtaaggaagggaaacaggaagagacttgttaattcagcccagcagtctccccacaacctctggggatggcctcatgggtgtgcagggcctccagagctaaaactgtttgagagaaggcttctgtgctgtccataccaggcccctccccagaattcagccttgctccaggcgggctccactggctgcctacagacaggccaacccttggcttccccatggccctcgccaccaagatcacacagccctgctaattagttattgatctggtattttgttgtggctgcgcttcccactcctgtgtttagtcgattcccaagttaatgaagctggattctgtaccgccccccttcccccccatcacctctctgtgttcccactgctgctactccaacggaatggctccagacaaagaccactgaaaacgagccgcactcctgctaacaggaagacagcggagaagcaggtgggaggaatattccccctggaatcagctgcagaggacgcctgttgcctttgttgggtcaggtctcctgcggcccagcattttccatggtggcctgaaagccaactgtggcatgagggcgatgtggatcaaagagcttcttccaccgtcacaaccctgtgtctctgggtgggcctgtagggtagcagatggtagtctgggaaaaaccacttcttcctttctgggtaatttttattcagtcatttaactcctctcagcttccatttccttaaaataggcattctgttgtatctttccagggtattgggaggatccagttggatgctctgtgaaacttctttgaaaacagtaaaatagtataagaaggaatcatgggtttgctattactcttagggagggactgggatccaggacaatctggaatggggtttcagatgtggaaaaaattaccattctgctcccctgcccatgtttgtattaaatgaaactgttcatgagagcatcagaataaggggttgatatccagaatatataaagaactcctacaactcaacaatgcaaaaacaacccaatttacaaatgggcaaggaagttgaatggacatttcaccaaagaagatatacaaatggccaatgtgcacatgaaaacatactcaatatccactgatcattagggaaatgcaaatccaaactgcagtaagatactacctcctacctattagaatggcatgatttaaacacacagagaaaataacaggcgttggccaggatgtggagaaatgagaacctttgtgcattgctggtgggaatataaaatggtacggcccctgtgaaaaactgtggcagttcatcagaatttaaacagggagttcccgtatgatccaacagctccactcctgggtttctgtgcaaaagaactgaaagcagagaccctaagagatatgtgtacacccatgttcatagcagcattattcacgatagccagaaggtaaaaacaacacaaataggcattgacagatgactagacaaacaaaatgtggtatctgcatacaacagaatattattcagccttcaaaagaaaggaaattctgacacatgctgcatcattaatgaaccttgaaggatattatgctaagtgaaataagccagttgcaaaaggacaaatgctgtatgattccacttagatgaggtgcctagagtagtcagattcatagagacagaaagtagaatgtgggttgccagggcctggtgggaggagggaagggggatagggtagtcgaattcacagagttggaaagtagaatgtgggttgccagggcctggagggaagagggaagggggagttgctgtttaatggctgcagagttttggccggggatgatggggtcattctgaagatggatggtggtgatggttgtacaacagtgtcagtgtacttaatgctactcaactgtacacttaaaatggctaaaataatatgtatattttgccacagtttaaaaaataaaaatatttttaaatggttgaaatggtagatcttatgtacagatgctcctcagcttcacatggggttatgtcttaataaactgtaaatcagatataccgtaagtaaaaaatgcattgattacacctaacgtccctaacattgtagctcagcctcacccacctcaaacgtgctcagaacactaacactagcctacagttgtgcaaaatcatttaacacaaagcctattttataaggaagtgttgaatatctcatgtaatttcttgaatactgtactgaaagaaacaattcaaagtgcagcttcttctgaatgtgtatcactttgcatcatcataaagtcgaagtgtcataaattgaatgtaagtcagggtccatctgtatattttaccacaattaaaaaaaaaatcaaagacagcttttaagggggatagaagcctcaaactggcagcctgtggcccatttagaagattagagcagcaattcagtcgtgttggcttggggcctgggactttatgggatccaggggcttataagcacccccaagcctttcttaggaccttagtaccgactggtgtagctactacctgttcctctgggttactgcccgggtgtccagtagaaccccccagggggtggagccagggtaatggcccccagcctctgcccagatagtaattttccattctagtcctgccctagcatctcagctgggtttggaccttctttcttggtttggggggagcatagcaggtgtcctgggcctatgccagcagcagctgatctacccgccccagaagagccgaacaccatgaggaaatttccacagctttctcgccccctgccctccgtcttctcaggagtgacttatcctctgttctctgtaggttttcttttcctctgcctgcagcattgccgtggatgccaccctgagaaagaaagctgaaaagttccaagctcacctgaccaagaagttccggtgggactttgctgcggaacctgaggactgtgccccggtggtggtggagctccctgagggcatcgagatgggctaactcggggagcgctctcagctgcgaggggccccttcccacagggctgcagtcctggcctctccatttacttcttcccatcctgggacctgccagggcagcaatctctccaggtcctgcaaagatggagccagaattccctttttcactgataaatatatttcttcattgccaaagaggctgtacccatcctgaaggcacatttgtgggttccccatcagccaggccttggtgctaacctggctgaatttcacacaggctcttacacacacacgctcctaggagacatctgcctacacggcaaccatatttcctctgaatgagaaggaattgaaccaaaagtccaagaaagaactgattgcttgttccataggagcttaggaaacaagaaaccctggattgcccagggggtctgagaagttggttggtgactttttttgcggttaaatgaagggtgatggggagatcagcccgaattgccgcctgcctcttgctaaataggagcagaggacttggcctgcagctccttgggagcccttgattgggaagagagtttcaagggaggcagctggattcaatctagcaggtggtcagcttcagctttctccatcgaaatcccattctcctgtccagaggcccagtgggtcatctcccaaggtgggtgtggaccctggcctcagaggccttgctggtgctgtcacctcccacctgttccattccgaggcctcacccagaagtgggaccctccccttcctcaccagagccaccgtgactgtttctgatgacctggagagtcaacaacaaccagaaaggtttctgcccagagcaggcttcttaaggcctttacgaagttttgtgccttccaagtgctgaagaagacctggtcagcctaaatcttcccagtcccgctgtggagctgtcagtcaccggagtaatgagctcctggttcctcgggagtccttcgtgctgtgtggcagggttcctctctagacaagtacacaggccctgccaccctgacatcaaactgttgtactatgatcacagtccctgtgccatccttttccaagactggggctcacaccatgtttttgaatgagaatccctgctggttgagacttttgcttccacttgtttccttggagatgtttttccaagagcataatgtacattaaagtcttcgagttgagacaatccccttgtgtgtgtgtgtctcttgcagttaatccgcctgatctccagagcagccaggctactgtccatagacacacacctccctccagtgtatgggagacttgcccaacctctggagtctggaagaggcaggcagccagtgttcctcctgttcctcttgaggcccctgagacaggcacacaaggaagaagggatgaggccccatgtctcaataataacccaagaatcacctgatatgaattggctcctctttttctcccaaagcccactcatcagaactagctggggagcttgtgaaaactgtatctttaaaggagtgaagtcctgatacatgctacaacacggatgaaccttgagaatgtgctaagtcaaagacacaaggaccacctattatgtgattccattcacgtggcatgtccactagaaacaaatccacaaagagggagagtcaattagcggttaccagagaataagacagtatggaatggcagtgactgctgatgagtctgggatttctttttggggtgatgaaaatattctggaattagatggtggtgatagttgtacaaccttaagaatttactaaaaaccactgaaagtaagcacttgaaaatgattaattttggccgggcgcggtggctcatgcctgtaatcccagcactttgggaggccgaggtgggtggatcatgaagtccggagatcaagaccatcctggctaacatggtgaaaccccgtctctactaaaaatacaaaaaaaattagccgggcatggtggcgggcccctgtagtcccagctacaggctgtggcaggagaatggcgtgaacctgggaggcggagcttgcagtgagccgagatcgcaccactgcactccagcccgggcgactgagcaagattctgtctcaaaaaaaagaaaaaaaaagatttttatggtatgtaaattacatctcaataatttctgaaaatgcagattcccaagtcccatcctgcagaaattctgaagcagcaaatccagatgggacctgagttctgaggcacactcagttttaagtaacattacctgtaagtgacagcattgcgattagtacctggagcttccctgggacagaatttgtctcccatcagggcagtacctgaaagttggatcatgtaaccttgttctccaagcatgtcagtcagtattcctgtgtttacacagatacacgccccctacacacacacacacacacacacacacacacacacacagttaacaggttaaacaaaactagctactgtttaccaagggctctgttctgttacttcactgaaatcctcagcaatatgtggtaagtactccaactatccccattttgctgatgggaaaatgggctcagctgaaatcactctgccagggtcacagccagtgaatactgagaacaagagtcaggcccatgcctctggtgtccacagcccactctgccgcttcattcacagctccgatttccttccttgctggccccacgtgtccagggcagccttcccctctgccctgctcccagccttggccctgctgccagccagccgtgtgatcttgagcaagctgcttgttttctctgagcctcagctcctcgcatgaaataagagttggcttggggccgagcgcggtggctcacgcctgtaatcccagcactttgggaggttgaggcaggcggatcacaaggtcaagagattgagacaatcctgaccaacatggtgaaaccccgtctctactaaaaatacaaaaattagctgggtgtggtggcgcatgcctgtagtcccagctaatcaggaggctgaggcatgaacccgggaggtggaggttgcagtgagccgagattgcgccactgcactccagcctggccacagagtgagactccatctcaaaaaaaaaaaaaaaaaaaaaaaaaaaaaaaaacaaaaaggcttggatttaggtttctgatatagaatctgcgggctcccacaggtatttaaaagttgacccttgtgttattttaaatgttttgaaaacggaaactacatttatacaggataatatggctgggctgccaaaaaaaaaataggtctcttttgtttggggctgcagtgacatccactttaggtcttctcctgctcgtcccaacgggcagtcctctgtatgtctttgatgaataagaaatgtgaaaacagattaattattacttaatacttacagtatttttggaaggcagacgctttcggaacagaaccagtggtgttgctgatctcacgctcccttccagctctaacacatctacgtgtgaagctattggcaggacctggcctgatttaaaaaccctctcaaatgcaggcctcatggggtctatctcttatttgcaaggctggctcatcctattagcagaatcagcagaggtagcgactttctaaccccttccgctgtccccatgacaaaccctccctgctgtgagcctccctcgttcccatcgaatttctcaccacttgagcagtggaagagttccccactgttgactgcctcttaccattatctccccaccatcatccccttgtaaatattccttaatattcccagggcactgggacatgctggtctctccaactaatcagactttggcttgactgagatgctgtcccctgctgacatgggggctgaaaatgcagagtgaatgccacggtcaaggccagcactgagtcacgtccgccagattgaaatcaggaccatactcctttcaggggaaggctcacctgagctacccagtaatccgggagcccgtgtggtcctgcagctctgcagacgctgcttctcttttcagtcccccgctgactgtagatggcacttccccacctcagattcactggatctggcctggacaggctttgtttctgttagagctttctagacccttccatcttcagagcatccaaggtctccggtactggctagttatcccccaaccctgggctcctggacgggcctccctgctgagagatgggctgagtggtgggatgagagtgggaaataatgtcagctgctcactactggggggcagggtgcgcaggcattcatctggcactcagctccccctgtcccctgccccaccaccaccccacccacccccagcctgccaggcctactctcatgtgtcctggatctgtgtcgactccctcgatttctctggaaaataggaatcctgagccttgtcaggctgacagctgcttggtgggaggaggcaaaaaataggggcgtctcagttgcattgtccagtgtcaggtggccctgccctaaagaaactcaacatttccctcttccctgggtctttgtcttgctgcttctctctcctgatttctccctcttccctctgtccacttccaaaaagtgcacctggctcaggtctggcctctcacttctaagggatgacagatggagttacatcttcaggagagcccgcctgcagtgaggagcgttggagaaaaatgtaggaccttcacccaagaacagaggtgggagggctggcctaaggaggaggtctccacatactcgagagtgtagagtggggacccggggagaagccacagggtggctgaggtcagctccatgcctgtggcactcagggaccacagtaagctaacatcctcgtgggggagccacacagtaagcatgctaagtagactgcagagtgggcccatcctgagaaatgctcctgggaaacaaaatagagcagggtaaggggaacggagagtcctggcagggtgaggggagacgctgcatttttttttttttttttttttgagacagaatcttgctctgtcgcccaggctagagtgcagtggcgtgatcttggctcactacaagctccgcctcccgggttcaagccattcttctgcctcagcctcccgagtagctgggactacaggcacctgccaccacgccggctaattttttgtatttttagtagagatggggtttcaccatgttaggcaggatggtctcgatctcctgatctcgtgatccgcccacctcagcctcccaaagtgctgggattacaggcgtgagccaccgcgcccagccgagatgctgcaatttaaagggggtggcatttggacaaagatttaaaggtgagcaagtgagccatgtaggggtctagagagtgttcctgcagaacaaacggcgaaggcaaaggccctggggcaggagcctgtcttttgtattggaggagcatcagggggtcagggtcagtaggcaggagtggggtgaccaaagacgagaatactaggagaggaaaccagggaccaggttgtccagggcctataggctgttgtaagacctgtccattttatcagcgaaatgggcacacggttgagggtttcaagcagaagcgtgtcatgacctgacttccatgtttttgctttttttttttcgagatggggtctcactatgtggcccaggctggggtgcagtggctattcacaggcgctgtcactgcggcctacagccttaaactcccagagtcaagtgacccacctcagcctcctcagtagctgggactacaggcatgagctacacccagcagctgacttctgtttgtaacaggatcccaagctgctgtgtcggacacagactgcagggggtaagtaagggtggaagcagaaggaccgctaaggagctagtgtgacaatccaggtgagaggcagcagtgactcaggccacagtcgtgtcgggtgcaggctgtgctgtaccatgattcagaagatggatccaaagggatgtctttgatggtcccttctagcctgataggccccacttccccagggtcgcagatctgggcagaatgccaacttgttgggcccgcacccgcacaggagttacctcttgactgtcccatcatggggtgtgttgaaccttcctattctcagatgtccatggtacatttggggaggtggggcaatgaggaaggattgggagggctgtcacgggttttctgggtgatggggtggcagtggaggacttgaagtggctctgttgagaagcagtgggtgagtcagggccccctgatagactgtggttgcaccatcagcacctgtgcggatgttcttactgctgatgggcagtgaggatggtcccacttactgttcaggtgtccatacgactaaaagggaattgagggccaccgccgtggctcgcacctgtaatctcagcagtttgggaggttaaggcgggcagctcgcttgagctcaggagttcgagaccagcctgggcaacgtggcgaaacaccatctctacaaaaaattttaaagttagccaggcatggtggcacacacctgtagtcccagctactcaggaggctaaggcaggaggattgttttgagcccagtaggttgaggctgtgtgagctatgatcacgccactgttctccagcctgggtgaaaaagcaagaccctgtctcaaaagaaaaccccaaaaaacaggagttgagggcatgtgaattctctgtcggtactaatggttcttggttggaatcattcatacacccacttctgccacggaacttcctggacgtagaggtgattactaagagccggtgtgtgttgggggcttccctcctggctgccgggcactatgttaggccctttacttgccttcctcagtctggagcaccagctctccagggaaggcctcatccttcctcgttgtccagacaaggaagaaggaagccaaggccccgcaaggtgaagggacttcccggaaagcagaggctgctgagcccgcctggagttggagcccaagcctgtgaatctcaccccgcccttgccaccatgcagcgctcctcaacaaagatggttacttaatccaaggtcatcaccagtggatccgaggctgcagcctggcaactggcagtatcagtcacttacaagggtggcaggcaggacccactggcctctggggtcatgacactttgctgatatttccacccagaccctttgtgtctgcgtctgggcctctggagacaccggactgacctggcccagagcaaggtggtacctgcgggtggggttgcttctgatctggaaggagcctgcctctgccctccttgaggacaacgagggccagtgaggggccactcagggtggaatgcccgagcaaaggcctccctcctctcacccatccctgtcctaccagaactgctgttgatttttgcaaaaggcattttctttagaaagagatgctacacacaggtatggtggcttacacgtgtaatcccagcactttgggaggccaaggtggaaggatcacttgagcccaggagtttgagactagcctgtgcaacgtggtgagaccccttctctagaaaaaaaatttttttttaattaagaaaaaaaagatgctgcaaaagcgaagcccctgaggggctgactcaatgaccaaccatcctctggataggcctcgcctcagctgcccgccctgtgaatcaataagcgagacactgtcactccaaatacagcagcctgaaagcaggagtgggatagggctagttagaggagctctctgtggtccgcttgaatgaagaagacgacaccattattcatttcccttttggaaattgtctattcatgtcctttgtccctttttctcttagtgtcctcatatgtttttgaaactgtatttatcatatcacaaatacattaatatgataaatatttcccccagtttgccatttgctttttaatgttttgattttgaaatgtatgctttattttttatattacgtatgtcgagctttttccttttgattttttccccattgctttaatgcttaaaagtccattctcatcttaagacgaaatgtaattaatctatattttgttccagtttttcttagtgttttttttttttattttttattttgccatagtcaaaatcatgtttcctcagccccacctgctccaggaccactgccacctttcatgcctcacatctgtcctcgatttttcctctcctattaagtcctagcatgctgcctcacacctccatcctcatcccctccttggacatcaagggcttctcacaaaccttcctgacccctcccggcatttgcagtcagaagaaccacatacgtggctggctctgggtgtcagagtctggtggagcggagtgtttttcttattgcttctcagggactagaatcgtctgctcaagattctgcatgtccatacttggaaggtcattgattggaagattcccccctcctctctgtccttgcactaaaggcccctacaataagggttgctgttattttagatttcatagtccatttctgttcacctcttttctgatgtcaggcctcctttgctttcaggacaactttttctgctccctgtcatctttggtgggactgccaatcacagtacctcaccccatccttccactcaccgggacagacacacaactctagctaggccacctggcatcttccctgggatgcttcttcaagaaggcgcaaaaggaccccacttgcttttagagctgtggctctagaggactctcagttagatctactaggggtcatcatccccgtcacagaaagccctcgtacctgaaatgaggatgagcccaacacagaaggaagctgagctgagagacaagagcaagagaagccaagaaaaatatctgaagcacctggatccagccttgcctgcatcccgcaatccccaggcttcctcctacataagccaatacagtaccttttaatttgagccccattatgaaaggtttttgctaaagaatcctgattcacccctgcattgcaatgctttggacttcattgtctgcccccctgtaaaactcctaagatgtcaaagctgaaaggggctttagagaccacagtctcatcctgcagttggtgaaacgaagggaaagaacttgtccaaggtcacgtggtgcatcgtttcctgctcaaaaaagaaaaagcttgaactcactgcccagcagcccggacggcgctgtggcctctgcgatggcattgcagtgcttagtggctattgatctgttgttttggatgtgttacccagacaggattgccaccaccacacaagcgcatgtgcagcccagggagagctctagggctgggccagagcgggggtgggtagggcatcgttgctgctgcttcagcccctgtcgggagagaatgagaaaatggtggtgaacaagaccttgctggcatttgctgacactcaccatgggccacgcgccatgttaaatgggcgcagtagctttacatttgttctcagccttgcggcgtccctatgaagtaggtgctacgggaatccctgttctatcagcaggaaaacaggaacttcccaatggtcacactgcgattgagccacgcacttggactaaccagggtcagcctgactccagagcctgattcttgtaccaaggagggggcaaaatcaggcaggacacatggatgagtggaggcccatgcgaggactgtgggagagtgtgccttggctccccagctccggcccagggcaaccaattcaaggcagacttgtcagagcttccagtttttcaagagaagccggaaatctggacttttatgtgaaatgtctcatttttaaatgttggcaaagaaattcagattaaaacacacacacacacacacacacacacacacacacacacacacacacagtgcaagggaacccaaaccacatttgcaagccagcggattgcaacttttcgactttactatactctttctgtggctggaggaagctgttctaacccacaggactctgtccatcacctggcaggagaggggacctacctcgatgtggttaggatgccaccctgccttgctcacactcactcatttctaagtgtgtgtcagaggccagcgaattccagaagcagggattgggcagggcgggcggtggggcatgcgtgcttgccagggagggccaggagcacagaagaagcctccttatccaatgttacaggtgaggaaattgagaccaagtgaggccgtataaacagctgggtccccggtgactcatggaaagagctgctggaaccgggtgcaaggtcttcctgagccataagtatggtcctctgaggacacattaccctgctgttggcctttttggctggtagaggagacacttggattctgggatgtggcagatcccagccttgcccatgataaggataataaggaagtcactgatagtctatgagccccagtttcttcatctgtaaaatgggcatctcctctgtaaaacagaggcattggctctgccccatgccaatgtaaaactatggcacccagtcccagaggggtaggggtgacattcctctcctccaggagcaggggactgagccaaagatacctgcagcccactctgcggtgcctctggggctgggactgttctgggcacgtgctgagttatgatgacacatccagagctgagtctgtctctcccacctgcccaatcctctggggcaggagtgggggtcgggaaggtgaggggcggcttcacttccaggtcaccatccctcagccctgggcctgacacagagaagaatgagcgggaggatggatgaacagcatcataacagcagttctcgtccacaccccccaacccgtgtgccaagctcttagctcacgccatccttcagcccagcagaatcttgtgctgggggtggagccgcagccctgccctcatccattcatcacgcgtatgcaccccttcttttcaggcagtggctcccaactctccccagggctcagagttgcccccgagaccctgacccaggcccagccagggcagctatccccaaacttccatgggacacttggtgtcagctgcctccccccatccttggcctggtgggacctaggggctctcagctacccagccaggagatcggcccccagcagaatggccctacctcagcctgtctgtgtctttgagggttctcagcgcttcacctggcctcagaaactacctctcagcctgagggtccctacaaggctttggactgatgccccctgcctcagcataaatggtcaaggttgagccttatggcccccagaaggcagggctgagatccatagggtgaagccatgggaggcagatggaaaaccttagtgtgaggcacaacttaccatcaaagctgcctacaatggaatgggctttttttaagaggtgagttttctgttcccagagatttggaagtaaaacctgcagccaatggggctaacacacatccattaggacagcggcctcattaaatgactgtgaggttcccttccagttcttagaccacgaatctcctttctagggtttttcttcccagtccaccccctaagacagacacaggccttcgcaggcctgattcagggtggaggaaggggagtcccaggctgaaggcgagttgtttgcaacccacagctgggctcaggagcagggatgctgcaacccagctgcctttctgcagggccttcacctgtcctccaaggaccaaggccaaggctgatatgagccccccatctggcccaagaggttcccacaatggtcctgggtggtgggtcctgccactgggtaggtgtgggagctgggggttgcaggttcaacttggcaaaatgtcaggacacccacgggggcaggcagcttttcaggggcccaaggccatggagctccaaaggagggcagcagggagcacgcagataactgtccccacccagctcccctcccacaggctccacggatcgcactctgtctctctcgcatgctccaggagagacacggcagcacacacacaggcagacacaaccagcacccacatctgagcgctcacacacagatgcgtgtgcgtcgtgcagagacgcccacacggagacacagatacacaccctcccggagccacacagatgacacccacgtgcacgcgggcacaaacacaggccctacctacttgcaaaccaactccacctccagcatggccaccctggctggggaaggaaggccggccgggtgggtgccctggatcagcctccttgccgtgggagtcctgatcatctggaagctatggcctgccccgcccattggaggtctgcagggccaggggctgcccagaggcaacagagtagttccacagggccctggggtcagctgatctggctctggtctcagctttcccaccttctggctctgtgacctgggcaagtcactggacctcgctgagcttcagcgtcctcatctggaaaacaggcataacatagtgccaaccccctgagtcctatgatctctgtagcccccaggcctggaatatcctagacgttcagtaaacagagactgtttctgtcaccccagggcgggggctccattggcaaatggccactcacccattgcagcctggcatttggtgagtgcaccatattcgtgagctattattttcatgtctacttcaaggggctacctggggtctgaactttacttgtggggacccaggatgtaagcctccatgtccagactggcaaagagaaccccattcccctggcaaaggtagggctcagctaggtagtcttaaacaataagcagccactcagctagaacttagactggaatattcgcaatttaataccatggcattccagaccacagctgcaaaaaacagaggctcttgccagtgtgttttagactctcaaagatcttgaagcacaaatctcgaatgtcagagctgtacagaggccttggagacatctagtccagctgtcttgctcctaaaacggaatcccagaagcatggagcctcaaagaactttgagtccattccagaccagttggacagaaattgggaactgaggcccagagagggtgagccactgagcatggttgcacagtgagttagtggaagtgttgagaccagacccctggtcccggcttcatagcaagtttagattcagcccctctatggaggcctggaggaaggaaggcagaagaagaaacatttgggccaaagtgaggattttctggagaactgttttcgaaaaatcaaaccaaaaagaaaaatgggaaaaaggtgctggcttccccttattttctgcctgtcttcctctgggcactctctctctctgcagctctcagccggttccagctctgctcacaagctgcttccagccgcccacgggcttcctaaaatggtctctgcaagctaattccagaggatgaatggcagagagcaggcctgcagggagctggtggggggggggggcggggggggggcttccttagccagtgcaggtgcagacagacgccacattggtgttggaccagctgcccccaaccccaaccccctccttaggtgcttccatggcccccagctgccaggaccagggggcccagctttcacctctcactgcctgacctcttggaataggttatttttccttcttaaagaattaatttttaaaattatgtaataatacatatgtatcatcaaataatcaggaaagtataaagaagaaaattaagatcacctgtaatcagctcctctaaatgaaacaactattaacaattaagcatatatcctttcagtcttaggactcagcacatattacagacagaggggctgattcagtacataatgttctaagtcctgttcttttcttccaatcatatattcacaagcatctttctagtcaacatttgcacttccacagcatgatttttagtggctgcatggcaccttgcatatgactacaccacgctttgctcaaccaatccccaatgcccagcgttttagcttgtgtccatttctcccctgtgagaaacagtacatggtttattcttgtagttacctctttgtaatcaacctagttatttccttaggacaccttcctggaattggaattactggccaaagggtttatacttttttaaaaagataaaatgcaaaattataatactatcctcccttcctataatgaatgtgtaataattaggtaataaataaaaattagaaaatatagataaagaaaaataagagaaaaaaatcataactttccccaaatcttactaccaagatatggttaagaattttgctggaaagcatctagacttttttgtatgtgtgtgcacgcatataatgggattatactatacaggctgttttgtaaaactgatcatttgtttctttctttttttttttttttttttttgagacagagtctcgctctgtcgctcaggccagagtgcagtggcgcaatctcggctcactgcaacctccgcctcatgggttcatgccattctcctgcctcagcctcctgagtagctgggactacagggacccgccatcaggctccgctaattttttgtatttttagtagagacggggtttcaccgtgctagccaggatggtctcgatctcctgatcttgttttccacccacttcggcctcccaaagtgctgggattacaggcgtgagtcaccgcacctggccaaaactgatcatttgttcatgtcaatacataaatttacattcacagtgtcactttctttcttttttttttttttttttagagacagagtctcgctgtgtcacccagactgaagtgcagtgacttaatcatagctcgctgcagccttgaactcctgggctcatacgatccacccacctcagcctccagagtagctgggactacaggaagatatcatcacacccggctaattaacaacaacaaaaaaaattgtagggataaagtctttctatgttgcccaggctggtcttgaactcctagcctcaagcaatcctcccactttggcctctcaaaatgttgggattacaggcgtgagtcgccacacccggcccacggcatcacttttatctgccacagcatatttcattctgtgtttataccttggtataaccactctcctgttttggggaactaggtttctggttttgctccagtataaatagctctgtaatgaacatgcttggaaaagcagctttgcttcttgtccatatgcgttcgtaggctctgtggtagtagaattgctgggtcaagggtttttgttgttgtttgttggttggtttttgttttttgtttgtttttgctgttgatatcacatcgtttctgactggaagtctaaacagcaaaccagcacgcaggctccaccgagttccacagacgtctacgggaagggcccagaatctgtagaaccaggcaggagcttgtgctgcatttcctgctttccaggctgattgcttagagaaaggccttggccttgaatggggcctttgcccaggaagcctcctctgtgcccaggaagccgggatcaaaattagcccccccggaagccaggagcacacaagctggttcctgctggctctctccagcctacttcctgcatacccgatacctcacgtgccctcttcctgtctccagatcccactcacctgagaccatgcacagagggagaatgaatgtgacgtgttacaaagtcctcattgttctgaggaggggagagatgcagccagggcaggcagcctcgagactgggcaggtgtgagcccgggcggtgggtctcagaggtgcatggagggtcagcctggagaggacagaatgcggggccaacccacaggacaaggcccagagcaggaagggcctggagcctgcagaaggcaacaaggagaacaagcccgcagaaggacagggagggcctgcccagagcttccgagggtgctgacggccaggccggcctggacaccgtcttgtctctctccatccttcactgcgctgctctgctctctgcgatctcactccattcagagttgggaaaggaaagatccatctgaggaaaaggtgagctgagaactaaccagaaagagagggagggaacgggcgagggagggagagagaaaggaagaaacagagaagggaggagaggccaccacccaaaagaggaagccatgccatccaggtctcctgattgaccagcacaggtttaagtgaagaccttccctgtggtcagctcagcagtggctgcaagccaggctaggtggctcaggtctgtaatcccagcactttgggaggccaaggcaggcggattgcctgaggccaggagtttgagaccagcttaggcaacacagtgagaccctgtctctacaaaaaaattttaaaaaattagctgggtgtggtggtgcgtgcctgtagttccagctactcgggagactgaagtgggaggatcgcttgagcctggagttaaaggttgcaatgagccgtgatcgcgccactgcactccagcctgggtgacagagaccaagtctcaaaaattaaaataacaataatagtaagaggctgcaacagaccttcaagctgggagagcaggttttcaggcagctcaggaccacaatcccggttctaaaaagtgcgtgcaggcacgtctgacaacaagacagccatgcaggtctgggcgccagctaagagaggagggtcccacattaggttcagccatttcagcttctttccactcttgcctggcattgaattcccgtatttattaatcccctctagagcacaagtgagcccatccttgtgagatgagggaaagcatcagggctgtcctgtgcaaacccagtgcagcacagtgcccaggccatgtgcttcgacactatgggcagctgccgaggagacatctctttgagcaaagtctctctgttcatcaccctccccctccccagttccctttttgtcacttgattcaggtgggattcacctctccgtggcctctcctctctttccttccccacctctgcactctgggcctgctgggaacggaggagagatgggtgggccatggtgtgcttcgttcacaaacacccacccagcacccagatgtgactgggggaggctgggtgggcaatgacctgtgagcctgtaggccaccccctttcacccaggggacagcttctgggagcctgaggtcgggggtcttggagaaagaatagaagcacacccttggctccttcaggtgggggttgggtggagtggagagcagggctcttgcctgaacagtaatatcataaaactgtgaagagctggccgggcatggtggctcacacctgtaatcccagcactgtgggaggctgagatgggcggatcactgaggtcaggagttcgagaccagcttggccaacatggcaaaactccgtctctataaaaaatacgaaaattagccaggcatggtggcgcactcctgtaatcccagctccacaggagactgaggtaggagaatcacttgaacccgggaggcagaggttgcagtgagccgagatcgtgccactgccctccagcctgggagacagaacgagattccatctcaaacaaacaagcaaacaaaaaaaacaaaaaacacaaaatactgtgatgagttgacatttaagtgcgatcagtatgcgcctggaactgtcgagctggtaccttacttatggtcataggaggtgggtgccgtcatcatccccattttatagatggaggaaacaaggtgcagaggttgagtaactggcccaagatctcacaaccagcaggtggcagagctggatttggagcctgtgattgtcccacccagctaaagtctaatcaggctttctgtcctccaagctctgagaagccatcctcggcttcccagaacctttctttccttggtctgagctcccgacccaccccctgtctggactggagagaggaagtctggaagccacccagtctccatccagtaagaacacgctcctgcccactgtggccccagtgcctacacaagtgcctgcaatatagtagctgctcaataaagatttgctgaacaagggccaggcttggtggcatatgcctgtaatcccagctacacaggaggctgaggcaggaggatcacttgagcccagaagtttgagaccacacattgagaccccatctcaaaaataaaaaagtttgctgaacaagctctgccctgtgtagctggtgctgggactcacagcgggcctgcagcagtcaagagagaggtctggagccaggctgccctgtccggtcccagctgtgtgttgctgggcgagtcgccgcatacctctgggctgcacttctctgcctgtagaaagagagattccccagtgcctgcctccctttgtggggccctgaacaaacgctccatggagacgtagctgctgttattattgctgccattacccagggacaccatctgtattcgaccctggggctggcagaacgtggttctctcccccactgcccctctcctgatgctactggaagcctgcgggggtgtggggagcctggcctggcccaggtcctctcctcacccgtgtcaggaaagagaccctgtctgcacctgtccccagccccagccccagcccagctgctattcttagtccctccccatttccctcatctctaggcattttccctcctaaacttgctctgcgtttccataggaaccaggggagggtggagatggggagagggtcctcccccacggaagggaacttcatttggggctgtttgggagcggctggcagtgcctggtggaacttcccccactgtgcctctcccctcctccccagacccctccttgaacagcctgttcctccgaccgttatttttaatgcatttatcctgccgcttaatttatcccgcattgtgatcagatttagctgagagcgctccgcagcccggcctgcctgcatattcatgagtcggttcattcatgccgcccccagaatgccgggcaatagtgggcagtgcgctgcctggtccccgggtcccacctgctgcaagggcaaccgggggtcagaggtcaagggcccaggctgcagccagagagcggttgtagggtacagcacctgtgggtagggggtggggggtgtccctaggtggaggctctggagccaaactgtgctaacatctttctctgccattgctgataaaatcacttcacttctcagtttactcatctgcaaaaggggaaaataatgtcccctgccctgggtcactggaagattaagagaatacacataaatgatcacagtgggtattcagtgtagctccctgttgtcattgtcgttcctgctgagcagtggttcatcgtggctctggttcctggagaaacggggtggtgggctggggcatgagtctcctctggtgatgaggctgtgggctatttctgtccagcctttgctgactgtgatacgagctcctcccctcaagtgagggtcaggagggcagttcccaaaaggcaggagggaccagaggatgcagtctggtctctcaggaagggcccctgggatcgtccagggtgtgcagcccccaccaggggccagcagggaggctggggctctggaaggaggcagggctctagactccaggttcttctggcccttgggaacttctaggttgatcactcccttcaattattcattctgttattttactgttgccaagcccatgctgggctctggggacatcgccctgtcctcagggggactacatcccatcagagaggtgagtccaggctacggagtggtcagggccttcagatgaggccagatcaattgcctgggggttcagaaggggaggaaatcatcgcagctgggcatcagggaaggtttcctgtaggaggcagcatttaggccgaaccttgaaaatgtggctgtaacaagattggatggagtaagatggatatttggggtctaagggacagcaaaggcaaaggctggtgatgggaacgcaggttgggagaggtcagccaggtggaggctgggagattcctgagccccaggtgagggggtcccaacttacatcagccatcccccaaggtgggagccagaagggccttacctctgtccctcacatgtgtgtgtgcacacaggggtcacattccagcttgctggggaaaagagaagagctcctgcctgggtctcctgattaatctataattaaatcagcacggacgccacggaaccatgttgtcattagagagctggtgagggcagaccgggatttccctgggaaccgggaggcctgccgggtggctgcagcccatgccatgaacagatggccttcaggggtgaggagcaggaacgaaaggccagagcctcagccaggagtgagaaaaacagcagcttactcttggccatttacagtgtttctgtcactgtcttggttaatcctcatgacatgccatgggcgggaccaggcggggtattattatttactcgcattttacagatggagaaactgaggtgtagcgagccaagggatgagccagcctggatccttgggttttggaatcagagaatcgtgggtacgaaattctcttgccagctgtgtgctctcaggcagattgcttaccttctctgtgcctcagtttctccatttgtatattggggacaagaccctatcacttcaaagcattgcttaaggattgaataaggcagttcacataaagaacttagcacagtgcttggtgcttggcaaatactcatcaaatgctgctacttacacttcactgtaactgcttctctcttgtccatctttcttaccagaatatgggctccatgaggatagggactgtctgtcttgttaatttcatagtgttcaataaattactagtatgtgagacagcctttcgtaagctgcaaaatgctaaaacattagatactattttctctatgttctgccttgctttctctatgttctgccttgctctaaaaaggattcaaggagacaagtattaatattattatctttgttattatcactgttatgtaccaactctgttactcagaggtggttcttccttaaattaatatagaaaaaatctaggccgggcgtggtggctcatgcttgtaatcccagcactttgggaggcagaggtgggtggttcatttaaggctaggagttggagaccagcctgggcaacatggtgaagcccagtctctactaaaaatacaaaaattagccatgtgtggtgatgagaaggaaaaggagaaggagaagaaagaaaagaaaaggaaaagaaagaaagagagaaagaaaagaaagaaagaaagaaagaaagaaagaaagaaagaaagaaagaaaaagaaagaaagaaagaaaagaaaaaagtctagaaatagtcaaggagcctcaattcataggtggccgctaagaggtgaggcagagacctggcttctggagggaacatctagagacagctgcagaaacctctgggccaaccaaggagctacagcctgggaggccctggaagaactccttgctcttgtaatttgggaggctctggattttcagcaagaccagaggggctggaacctgcagcccactggctgcagattagatctaaggaatctgtctttgaagagcgagagggcatttggggatcatcattatctccgtggcacagtggtttccaccccctccactgggaactgaggtttcttacacaaataactgttaaagtcccagattcccaaatgagttactttaaatacgatcaattagagcagattcaaagttatccctgagacagtgtggccccatgcacctacattcttgagtggacagtgaaggaccagagctgtctgttgttcacagagcctctcttgcctcgagcccctgaggaacgatgactgttggctgtccctcacctgtggacatcacattgtagcacaggctgctgtgtcctgcccacattcccagaggtgcctgccagggctccctgtgactctcagcccgagactctgcacagagcccacttctctagaagtaccaagactcgattcccccggagctgccctcgagcaaggggcctgggggacggccaagaaggacttccttgcacctcaatgagacagtcacccacagcggcagctcctgtctccacttccctccctttcctggctcgttccccttgttccaagtaaactacttgcacccaactcctcatcccaggatctgcacttgggggaacccaacctaagacacactccaaaattataggtgctttattgtcctgcaggaatttttgagaggtgtccaaacctgtggatactcctgggagggcatccatcatatgagctctgagggcacctggggcttggtcgggtcagggtcgggggagcagtggtcagcagatggttctggtcaatagaggctgacgataaatcgaaagcctcccctcaatgcttcgcaggagcaggtgcagatcctgaactgaggactctgtgctgaagcagggaggcacctgatttgtttggtagtcaccaattaagcacctactgtatgctgaggataaaacaggtgaatgagatagcaaccatccttgtccctggggaggtctgagtctactggggaagagagtcatatcaacacatggatcaaggttagagatgagtgaagaacttcagaggactctggtaaattcatccattcatttaaggcatttattgagcacttatggcatataaggcaccgtgttaggccttgtggatgaaagagataggctatcatcacactactcagaaaggagacaaggtaacatctgacatttattaagctcctactactgtgtgcaaggcactgagtagggtgctttccatagtttatctcattcccttttgtttgcttgtttttgttttgttttgttttgtttatttatttatttattttgagatggagtctcgctctgtcacccaggctggagtgcagtggtgcgatctcagctcactgcaacctccacctcccaggttcaagcgattctcatgcctcagtctcccaagtagctgggattatagatgtgtaccaccatacccggctaatttttgtatttttagtagaggcggggtttcaccatgttggccaggctggtcttgaactcctggcctcaggtgatctgcccacctcggcctcccaaagtgctgggattataggtgtgagccattgtgtccagccttgttttgtttttttgagacagggtcttgctctgttgcccaggctggagtgcagtggtgcaatcatagctcactgtagcctcaatctcctgggctcaagcagtcctcccacctcagcctcccaagtagctgagactacaggcacgcaccaccacatccagctaatttttgtattttttgtagagatggggtttcaccatgttgcccaggctggaatctcatttcttatcacaacaaatccgttatgggggtaggtagctattcttatccccacacagagaagaggccctgaaagttgatgcaactcacaagaccacatggctgggaagtggcagagctgggcttcaacctagatctgtcggattcccaaccccccatactattttttccctcgcatcagaccacggtctgtggcttttgtcttaaatacccactgagtgaaccagtttttaaaagaacaaaacctggaagcaaaccaggccaggctcagatggagctagaacaagcgtttgctggggtcaagctcccgctccgaggccctgcctcatctacagggggcctaagcctggtctgtgacccctgtctgtagggaatccaggacacctggaagctgacctcatttcaccctgaagagtcagggaagggaggctcgggagaggccctgctccctgtgcccagtgggcctcccatgtggactgatacatggttcagcaaagcccagaccctcccaaccacctccccaaaggtagtcaaggcagagcctggctgctaatgggaggatgttcctgttattattacaggaaaaaaaaaaagtcagtctaaatcttagtggcttaaactaacaattttgctacgtttacagactctgtgggtcaagaatttggacaaggcacagtgggggtgtgagctccatgatgcctcgtgtctcacctaggaagattcagtagctggcggcaccatgacagctggcagctggaatcatctgaggatcatcacccacgtgtctggtgattgatgctggctgtcaggtaggacctcagctgggctgtcagccgaaacagctacctgtgtgctgtctcttcctgtgggctagtttgggcttcctcccagtatggcagctgagttctaagggcaagctgggttctaagggctctcttcccaaaagagccaagtagaagttgaatcgcttttatgacctaactttggaaatcacatagccttgcatcacttctgcaagagtcacaagtccacccaaattacagagagggggacacagacctcacctctcaatgggataacatatggaattggagatactgttaaggacatctttggccacataattaactaccgaaaacagtagggaggaattggctacccaggtgtgagttgttgcctcaagggtggaggggcagccagcattgaatgagagccagtctgaatggatgacagggagagcagtttggattgaggttgacttctgagatccaggcaacaaggccagagataccaaggcagaggttcagctggacgcagaggaacaagcattgttttatttatttacctactacccctccatcagtctggccacctggtctcccatctatctattcatcaatccacacatccatccatccatccatccatctacccatctacccacctatccattcatcctccatccacccacccacctatccatccattcatccacctattcatccatcacccatctatccatttatccatccatctatcctttcatccatccatttattctacccacccatgtatcttattcactttcactatgactcagtttcctcatctgtaaaatggggatcgtaatataaacctcatgggattgtttgaggagtcaatgaattgataaatgtaaagtccccagcacatattaagagctcgataggcttggcacggtggctcacgcctgtaatcccagcactttgggaggccaaggtgggcagatcacaaggtcaggagatcgagaccatcctggctaacacagtgaaaccccgtctctaccaaaaatacaaaaaaattagctgggcatggtggctggcacctgtagtcccagctactcgggaggctgaggcaggagaatggagtgaacccgggaggcggagcttgcagtgagccgagatcatgccactgcactccagtttgggcgacagatcgagactccgtctcaaaaataaataagtaaataaataaaaataaataaaaaagagctcgataaatattatcaatttttattaacattagtatgattcttactgttattcaggcatgtacccacctataaatctatcttcccatccactctcccattcatctgttttttttcatttattcagtagtacagttaaccatatgcacatttaatttacatgagttcaattatattcttagcaataaagaaagacagaaaacgaattttaaaagcacagttgacttttcgtgccatttttgtacaatgggtgtgtggcccagaaggagtatgaggtgagccatgttactaattgcggggttggggtgagagcaaaaccacgtagctgcatttctggggcagtttattggattttacagggtaattttaactgttcatggttcatgctgactttcctaccttttagatggcatgggacccacctctctgtgatgtgctctggctggctcccagcagcacagatacagtaggacctggtccctgccctcaatatactcacagtgcatggcacgttcagtggcacagacacataaacagaccatgatggtgtagtataaaaaattcaagctggagaagcactgtgggcaaatgactgctgtgaggagggcaaaaagagcagcagggaggcctttgtgagtgtgtgacatttaaacaaaatcttaaagcttatgagcataaattctcaagacactcaagaaggagaagggcgcaccaggcggagggaacagcacgttatgcagagagatgaaagatcacagggtgtggagagaatggagagcagggtgggagggcaggagtggagggacataagtctggaggtgtcatcggggctgatctgaaagggcctatggtaccaagccaggggatcttgggctctattctgcaggtggcgggcagccgtggagaggattaggcagaggagaggtagggtcagagttgtgttttcaataaatcgctcctgctgctgtgtgatggttgaacaggaaaagaaaagtctggaagtacagagaccagagagggaggctgagccccacccggcttctattgagttctgggacggtggggctaccacagaggaggcctgaagacagtgaaccaagggccccgttattgggcaaatttaccactttgggcttgagattcccaatatatggcctcacaagtgttttaagttgaaggagcagatggctctcctcagggtcagctagagggcttaggttctgcaccccataaagtctgcctggggctggaaagggctcttcactggatatatagtgtcgttttattgttttttgttttgttttgttttgtttttttcttttttgagatggagtcttgttctgtcgcccaggctggagtgcagtggcgacctcggctcactgcagcctctgcttctgaggttcaagcgattctcctgcctcagcttcctgagtagctgggtctacaggcacgtgccaccatgcccagctaatttttgtatttttagtagagacggggtttcaccatgttggccaggctggtttcgaacttctgacctcaagtaaaatgcctgcctctgcctcccaaagtgctgggattatagatgtgagccactgcgtccgacctgttgtttgttttttaaatttatctcccttagggttcattttgactcctgaatctgagggttcatgtctttcatcagttctggaaagttctttgaatgctacctttcgcccattctctcaattatctcttcttggaactcgaagtagaggttgtcagacctttttcatctatcctttgtgtctgtcttagttttccctccatttctttctgctgtattctggacaatttcttcagattccaagtcacattttttttctcttcagctgaggttaacaacctgttgtttaacacttctaagagttaaaaattctaattattgtatattttttatttctggaagtttggcttggttctttttcaaacctgcctgttctttctgtagcatccctcactgcatattcattgtttcaagctcctctattctgtctgtaaacacatggaatatatttactgtattttacattttgaatcctacaataccaatatctgaagtctttggggatctgactttgttgtttgctgtttcttctgttttgctcagggtggcatgtctcttggatgctttgaattttatttttattttcagttggacctatgggaatttcactgaggaccaggctgaaggtgttttcttccagggagagtgcaaaacatttaaattgaattgttattgaggggaacatacaatagagtgcattaatcttaaatgtacattttaaatggatatacatccccataaccatcatccagatcaagatatagaacgttctcagcactgcagaaagtttcctcatctccctttccagtatacctgcaccccgagagggaaccccattctaacttctaccaaatcactgatgagttgtgaaatgatatacaaatgaaaccatatagtacattttcttttcttgttttcgagacagggtctcactctgtcacctaggctggagtgcagtggcacaatcacagttcattgcagcttcaaactcctgggctcaagcaatcctcccacctcagcctcccaagtagctgggactacaggtatgcaccaccacactggctaatttttaaaaattttttgtagagatggggtttccctatgttgcccaggctggtctcaaactgctggcctcaagtgatcctctggcctcagcttccaagtgtgctgggattacaggcatgagccaccttacctgactgtagtattctttaacttgatgtatatctgtgagatgcattcatgttatcccatgtggtgatactgtctttattttcatttctgtgtagtattccattgtatgaatatatcacagttgggttttccattctcctgatgaggtctccaagttacatttgggtaatttctggttaggaactatgatgaataaagtttccatgagcattcctgtatatttcttttggtgagcattgcatttatttttatagggtaaataccccagagtgaaattactgggtgatggaatatatggatgtttggctttagtagaccctgccgaagttttccagggtggttgtgcccatttactctcccaccagccgcatatgaggattctgattacatccttcccagcacttggcattgacagtttttaacatttgccattgtggtgggagtgtagtggtatttcactgtggtgttaatttttattttcctgatgattaatgatgtagaatacctttccatgtctattggctattttgacctatttgatgtagtgcagtctgttgcctccttttttctgaactcaattaagtggaattcactgcaaaggtaaagtggcttatattccaagttatgtaacacctccagcacagtgtagggcagtgatgtgctggcaaactggttctcagaatttttttttttttttttgagacaaggtcttgctctgtcttgcaggctggagtgcagtgacacaatctcagctcactgcagcctcaagctcctaggctcaagcaatccttccacctcagcctcctgagagttgagactacagggtgcgctgccacacccggctaatttttgtatttttatagacagggggggttcaccatgttgcccaggctggtctcaaactcctgggctcaagtgatctgcccgcctcagccacccaaagtgctaggattatggacatgagccaccgcgcccagccagattggccagattttttttagtagcctgatttgcagtattttctgatttctatgatatacatacttcaaccatagccaatttcaagctactgaatggcttgcaaaactcctgaatatttaacaaatggctcccatgagccaggatggattggctccaggataccactgcgtctagggtagcacctctaataaaactaattgatatttctgcagcaaactgtgtaaatattcacactaattggtgtaaaacatcttcatatccattgaggtcagatttttgcgtgcaaagaatcaaccatgaattaactgtaaaagaaggactttcagttgagaaagatctttggattttcacattgcacgtaaaagatagtgggtctgtttctgcatggattccactgtctgcagatttgctgatactgttgggatccttcgggaaatcctggtgacctttgtgaacagcagtgaacaatgattttgagctcagtgatgtccaaggtccctttagttctagaagtctatggctaaaaatttaagaaatatttcactaactgcccatttggctttatttctattttagtactactgtgggctggagtcttttaaaacatggtttctggagccatggagagatggtttctggtaaacccagcgctcgcatggtccttcccacagaaggttctggagtcaggctgcctagacttaaatcttggctccaccactggcttgctcttggatttggggcaagtcatgtgaaatccttctgtgcctttgtttcctcactgatcatgaaaactgaagtgtgaaaaaaggtggaattcctgaggcccatctctgggctgcccactgggggcttcctcagacacaggaccccagatggcattgagcatcttgagtcagccagcgttggccagtggaggggggcagtttgcagtggccacaggagaatcttactccacacgacttagtgccccggtgtttccccatcttccctgacgcagcttctttgtcagtggcgctcaggcccaaggcccatcccttcctcaagaaatcctgctcctacttgaggaaacttggcatccagggcctcccccaaccctggcaacagttcggaatccaccactgtgagatatctcagacctggtttcttgagtcttttgcttcctgtggggcctgtccggagaccctgatttagatctcgcctctctcccctccctctagaggcagtagaagctgtgaccaagctcatgctttgtgtcctggaccgtctgggccaagagaaggccacctgccggaggcagggccagtggccactcttgttgggttctcatcattaaactgttgttctgatgcctatttgtaaaattgggttgtctgtcttgttcctgtaggttcctgggagctcttccgtctggctatcagccatcagttggatacctatattgaaaacataatgtctcctagtctgaggcttgtcttttacctctcctaaatgaagagttcaatattaatgaagtctaatttatcattattttcttttatcattagtggttctttgtttgtttttgtgagacagggtcttgctctgttgctcaggctgagtgccgtggcatgataacggctcactgcagcctcaacctcccaggctcaagtgatcctcccacctcagcctcccgagtagctgggactacaggtgcacatcaccatgcccagttaattttcatatttttttgtagagatggcgtttcaccatgttgcccaggctggtctcgaactcctgagctcaagtgatcctccttcctcagtctcccaaagtgctgagattacaagtgtgagccaccatgctcagccactgtttcttatatcttttaggaaatgaagatatttattcatattttcttctagaatttgtattgtttttgtttccacatacagatctatgaaattgatctatcttgcaattaattatatcttcaattaatttttgtgtatggtgcatgataagagtcaaaattcctttttgtcatatggatatctagttttggtggcattatttattgaaaagaccaccctttcccccactgaatttcaggatacatcatgagccaggtgacatggcatgggtccagttttggactgtcgtcagtacttcgatctatttgtctttgcactaatgcccactgtcttgattactatagttctatagcttatttttatttaacctttttgtctcgagagaattgtagatttgcatacaattgtaagaaagaatacagagagatcccacattccctttacctggtttctcccaatggtaacatcttgcaaaactctagtataatatcacatctagaatgttgatattgatgcggccctctggtctaattcagatttccccagttttacctgtattcatttgtgcatgagtgtgtgtgtgtgtttagttctgtacaattttatcacctgtgtaggtctgcgtatccacacagagtgaagcttcagaacactttcatcaccaccagaatctcgtgtttcccttttctcagccacacccgccacccttccacattctctctccaccctactcctaaccccaatccctgacactcactaatctgttctccacttctgtgtttttatccagaaatgttatataaatggaatcgcacaatagcttttcgggattggcttctttcactcagtgtaaattcccttgggatgcacacggtggttctgtgtgtcagtagtttgttcctttttattgatgagtggtattccatggtgtggatgcaccagtttgtttggccattcatccgttgaaggatatctgagttgtttccagtttggggttactatgaatagagctgctataaacaatcatgtgaacatgatttttgtgtgagcataagtttctatttctcttggataaatgcccaagagtgcaatttctggggtgtatggtaattgtatgtttaggggtttttttccaattggttttattttgtagagccatcttaaattcacagaaaaaattgaatggaaggtacagagagttctcatatacccccatccctacatacgcagagcctcccccacctcaaaatcccaccaccagagtggtacattcgttatcatcaatgaacctaaattgacacatcattatcacacagagaccatggtttacattagggttcactctggtgtacattccatggcttttggcaaatgtaaaacgacatgtgtccctcattacagtgttattcagatcattttcgctgccctgaaaatcctctatgttccacccactcatccctctctacccccaacctctggcaaccacctgatgcttttactgtctccataattttgccttctccagaatgtcatatacagctgacacttaaacgatgcaggaggcaggggtactgaccctttgtgcagttgaaaatctgagtataacttttgacccccaaaacctaactactaataacctactgtttactagaaagaagccttactgataatgaacagttgattaacacctatgttgtatgttatacgtattatatactgtattcttacaatcaagtaagccagagaaaagaaaacgttattaagaaaaatcataagaaagagaaaatacatttactattcattcagtggaagtggataatcataaaggtctttatcctcatcatcttcacattgtgtaggcagaggaagaggagcaagaggaggggttgatcttgctgtctcaggggtggtggttcatgtgtgagttttttcaaattattgcaaatttcaaagttgtccaatatatatatatttaaaatccacatataagtggacctgtgtgattagaatctgtgttgttcaagggtcaactgtagttgaaatcatacagtaggtagccttttcagattggcttttttctcttagtaatatgcatttaatatttctctatgtcttttcatggctagatagctcatttctttttagtgctgaataatatttcattgtctgaatatagcacagtttacttgtccactaacctactgaaggacatcttggttgcttctgtgttttggcaattattaataaaactgaaatagactttcaagtgcaagtttttatgtgacataagttttcaattcatttgggtaaatactaaggagcatgattgctggatcagatggtaagagtatttttaattctgtaagaaaccaccaaaccgtcttccaaagtggctgtaccatttgcattcccaccagcagtgaatgagagttcctgttgctccatatcctcaccagcgtttggtgttgttagtgttttggatttttgccattctaataggtctgtggagtggtatcttactgttgtttaaatttgcaattatccaatgacatatgatgttgaacatttttcatatgcttacttgctatctgtatatcttctttggagaggtgtctgttaatgtcttttgcccagttttaagttgggttgtttgttttcttattgttgagttttaggagttcttcatgtattttagataacagtcctttaccaagtatatcttttacaaatacagtcatgcaccacataataatgtttctatcaatgacaaaccacatatatgaaggtggtcctatgagattataatggagcttaaaaagtcctattgcctagtgacgtagtagatgtcttaatgttctaggctgacacattcttcatgtgtttgtagtaatgccgatgtaaacaaacctaccgtgccgccagtagtataaaagtctaacatatacaattatgtacatttgaccatgataataaacaactgttactggttatgtatttactatatcatgtttttattgttattttggagtgtacttctaccattaaaaaaagtttacttaaaacagtatgccatggtatgctggcagcagctcatgcatctcatgtttatttttgtacagctgtacaatgtgtttgtgttttaagctaattgttattacacaagaggcaaaagttttttttgtcattgttttgttttgtttttaagacggagtcttgctctgttgcccaggctggagtgcagtggcacaatctcggctcactgcaacctctgcctcccggattcaaagaattctccctgcctcagcctcccaagtagctgagattacaggtgccagccaccatgcccggctaattttgtatttttagaatagacggggttttgccatgttggccaggctggtcttgaactcctgatctcaggtgatccacctgcctcggcctcccaaagtgctaggattacaggtgtgagccaccgtgcccagccaaaaagtattttttaagtttaaagtttataaagtaaaaaaggtacagtaatctgagttgagctcttgctgcattttgagagttctttgagagttctaaggttaatttattattgaagaaagaaaaatattttttacaaatttagtgtaccctaagtatacagtattcgtaaattctacaatagtgtacagtaatgtcctcagccttcacattcattcacacctcactcattgacttacccagagcaactcccagtcctgcaagctccactcatgataaatgccctatacaggtgtaccatttttaaatcttttacaccatgtttttactgtagcttttctgtttagatatgtttagatacacaaatatgtaccattgtgttacaattacctagagtatacaatactgtaccatattgtacaggcttgcagtctaggagcaataggctataccatctggcttaggtgtatagtaggccatagcgcctgggttggtgccagtatgctgtatgatgttctttgcacaaggacaaattcacctaatgaagcatttctcataacatatccccatcattaagcaatgcatgactgtatttcctcctagtctgtggctcttcttctcattctcttgatattgtcttttacagagcagaagtttttaattttaatgaaacccagcttataaattatttcttttatgtctcatgcctttggtgttgtttgtttgtatctaaaaagtcattaccattcccaaggtcatgtaggctttatcctatgttgtcatctaggactttaatagttttgtgttttacatttacgtctatgagccattttgagttaatttttgtgaaaggtgtaaagtctgtgtttagactctttttttttttttttttggcatgaggatctccagtttttccagcaccatttgttgaaaagactcgctttgttcctctgcattgcctttgcttctttgtcaagtatcagttgactatacttatgtgggtctatttctgggctctctattctgttccattgatctgtttgtcttttctttcaccaatgaccacattgccttgacaataatagctttatagtaagtcttgaagctgggtagtatcagccctccaactttattcatcttcaatgttgaattggctattcttggtcttttgcctcgctgtgtaacttttagaatcagtttgtcaataccctcaaataacttgttgggattttgattgggattgcattgactctatagatcaagttggaaagaactgacatcttgacaagattgaatcttctatccatgaacatggaataacattccatttattctgttctttgatttctttaatcagaagcttgtagtttttctcatatagatcttgtacatatttttgttagatttatacctatttcattttggggatactaatgtaaatggtattgggcttttaacttcaaattccacttgtttattgctggtgaaagtaattgatttttgtatattaactttgtatcctgcaaccttgctataattgcttattaattcccagagtttatgtttaattttattttttaaaaacctgtcatactgttttctagaggggctgtaccactttacattcccactagcagcatatgagtgattcagtttttctgcattcttgcaaaatctggtgttgtcactgtttttcactttagcaattctgataggtatataatgctatctcattgtgcttttaatttgcttttcctgatggctaatgatgatgaacatcttttcatgggcttatttgtcatcagtatatcttgtttggtgaaatgttcactaatgtcttttgcccattttcttattggattgtttgttgttgttgttgttgttgtttaaattattgagttttgagagttctttatacatcctagataccagccctttgttgtaaatattttctctccactatatgttttaatataccctgaaatctagtaatattagtcctatagcttcatgctacttcttcagtatagtctctgcagttgaaagtccgttggatttcatataaattttagaatgagcttatcaagttcccaagaggatgttaattgggattgggatctatagatccatgtgagaagaactgacatctttcaaatcgtgaaaaagtgctgggattacaggagtgagccatcgcacctggccatatttgttgattttttttttttttttgaaacagattctcgctgcgaacatgatatatctccccatttattaggttctttttttcatttctttctgcagtgttttgtgattttcagtgtaaaagtcttacacatctttcattagagatatttctgggtattttatgggttttggtgatattgtgttgtctatttaaatttctttgtttcggccaggcacagtggctcatgcctataatcccagcactttgggaggcccaggcgggtggatcacctgagttcaggagttcaagaccagtctgctcaacatgatgaaaccccatctctactaaaaatacaaaaaaattagccagatgtggtggtgggcgcctgtaatcccagctactcgggaggctgaggcaagagaattgcttgaacctgggaggcggagtttacagtgagccaagatcgtgccactgcactccagcctgggcgacagagcaggactctgtctcaaaaaataaataaataaataatttttttgtttgttgctcatatgtaaaaatacaaataatttttgaatatttgtttgtgtatagagactttgctaaactcacttattaactctaatagtttgtagattcttttggattttccacattcacaaaatgtcatctgtgaataatgatatttttattccttcagttccagtttgtacattttttctcatctttttgcactgactaggatctctaatacaatgttaaataaaaataatgacagtagacagttaatctaaagggaaaagcattctaaatgtttttcaccaataagtgtgatgttagctatagggttttataggtgcccattataaggtaagagaagaccttttcagtttctagtatggagaatttttattttgaatgggtattgaattttaccaaatgttttccacttttttaatttttttcccacattttttgaaatgatagttttttagaatatttttgaagtggtgaattatattggttttttggtgcagtggcaagatctcggctaactacaacctccacctcccgggttcaagcgattctccatctcagcctcccaagtacctgggactacagacatgcaccaccaagcctggctaatttttgtatttttagtagagacggggttttgccatattggccaggctggtttcgaactcctgacctcaagtgatccacctgcctcagtctcccaaagtgctgggattataggagtgagccatcctacctggccatattggttgatttttttttttttttgaaacagattcttgctctatcgcccaggctggagtgcagtggcgagattctggcccactgcaacctccacctcccaggttcaagtgattctcccacctcagtctccccagtagctggaattacaggcgtgtgccaccatgcccaactaatttttttgtatttttagtaaagatggggttttgccatgttggccaggctggtctcaaactcctgaccacaagtgatctgcccccactttgcctcccacagtgctgggattacaggtgtgagccactacgcccggccatattgattgatttttttttttttttaatggagatggaatctcactctgtcacctaggctggagtgcagtggagcgatctcggctcactgcaatctctgcctcccgggttcaaacaattcttccacctcagtctcccgagtagctgggaccacaggtgcatgccgccatgcccagctaactttttgtattttactagatacggggtttcactgtgttgcccaggctggtctcgaaatcctgagctcaggcaatccaccctcctcagcctcccaaagtactaggattttttattttaaaaatccgatttttgaatttaaaagcaacattaaattcatgaaataaatcacatttggtcatgttgtattgtgctttttatatatctctagatttattatgttaatatttgtttagtatttttgcatctacatttatgtagatattggcttataatttttcttttttgtaatgtaaagtgagtcaggaaatattcataaattgagtcaggaaatattccctcctttactattctctagaagaatttataggattaatgttctttattctctaaatatttgggaaaattcaccggtgaagccatctaggcttagataatttttgtgtgtgagaaggctttaaattagagattcaatatttaaaaataggtatagggctgttcaaaatttttatttcttcttgtatccttttggtaagtaatgcttttcaaagaatttgtccattacaattaaattatccaagttttggcataaagatgtttacaatattttcttattgccttttaaatgtctatagtatctatgggtgcagagctttgggaggccgaggcactcagatcacttgaggtcaggagttcaaaccagcctggccaatatggtgaaaccccatttctactaaaaataggaagccgggcatggtggtgcgctcttgtagtcccagttactcgggaggctgaagcaggagaattggttgaacccaggaggcggaggttgcagtgagccaagattgcaccactgaactccagcctgttggacagattgagactctgcctcaaaaataaattaattaattaattaaaatgtctatagtatctgtagtgatgccctttcttcattcttgatgtttacaacttatgttatctctctctctctcttcatgatccttttcaacgaaccaacttttggctttgttagttttcagatccatttaaaatggaattctgaggctgggcgcagtggctcacgcctgcactcccagcactttgagaggccaagatgggtagatcacctgaggtcaggagttcgagaccagtctggccaacatggtgaaactctgtctctactaaaaatacaaaaattagccaggggtggtggtatgcgtctgtaatcccagctactcggaggctgaggcaggagaatcgcttgaactgggcaggcagaggttgcagtgaaccaagatcacgtcactgcactccagcctgggtgacagagggagactctatctccaaaataaataaataaattctgagcttgaattttttggtatcacataaatatttagaattcaggccttgaatccatgtgagggccagtcagtatccacaacttctcagaggttactcctctttaatcccacccagacccaaagctgagacagatcattttctttgctgtctgtcttcatggggcaggattaaaaaaaaaatcacgcctttcctgagtccataatttatgtagggtgagctctgactcatttggctgtctgtcctgtacaggttgcaggctttgtattacctgagttagagatgtctgcatgacatccacaacgccaatgtaggctgatctctcaggactcatattcctgctttgtttctggcacaagagaatttctctactttcttgaagacttattcatttctatataatgtttaaaatctatagcatttgacagtggtgagaacgtagtatttctcaccttagggtgtttgtattgctgttccctccagctggaatgcttttcaccgagatatctgcagggctgcctcctttgctctgttcctcacaccttaccttctcagtgagtcctaccggacttccctatttaatcatcttcatcaactctagcaccccctattccccttaccttctctgcttttcctttttttgtttttgtttgctttttttacacagggtcttactgtgttgcccaggctggaatgcaatcatagctcactacagcctccatctcctgctctcagatgatccttctgcttcagcctcctgaatagctggggctgcgggcacacaccagcacacttggctaatttttaatttttttagtagagatgagatccggttatgttgcccaggctggtctcaaactcctagactcaaacgatgctctcctcccaaaatgctaggattacagacgtgagccaccatgcctgtctctttcctttttgtcatagaacttatagccatctgtgtcatttactgatttatcatgttttttgtttattgaccagttccttttgctagatgtaagcttcatgaaggcaggttctttatgttttctttactccaaattcctaaaacagtgtctggcacatagcaggctctcagtaaatattctctcagtaaatattcttttttttttttttttgagacagagtcttgctctgttgcccaggctgaagtacagtggcatgatcttcgctcactgcaacctccacctcctgggttcaagcgattctcctgccttagcctcccgagtagctgagactacaggcgcccaccactatgcccagctaattttttgtatttttagtagagacggggtttcaccatgttggccaggctggtctcgaactcctgatctcaggcgatccacctgcctcagcctcccaaagtgctaggattactggcgtgagccaccacgcttggctcagtaaatattctttaaaaaagtgtccagaaactgagtccttttattggacagaggggaaaacaggagtgcagagagggaaagggatttgtctaaggtcacctggagagatggtggcagaaccaggaccagaacaatttctcctggcctgttacgatgtgccctctgcctcctcggagcctccccgcagggctcaggtatgagtggtgcggaagcagcctgcatctcatggcactgtgggccactttctccttcgggaagcacagtctgccctgacttctgtcacatgccgctccctgttttccttctccttacctgcttacattcttttagcctcttttgcttgacccatgaagtggctatgtccttaggctctgtctttctcaaggccctcttattgaatgaccttgctcactccacaccttcagtcattccctctccaggctcggtctctcccaagtgcccatttttctggacatctcttttcaagcctctggatgcctggcaggctccttgtgtgcaagagaaaagccttggtcctgaagcaaaatacctggctccacattcactcagtgaacccgtgggtcaatcctcaccactctctgagcctcgaagtttccttctgagaaaaaggacatcttttcattcaatccccacaggtttgttgggaggttctaggaagactgtggattgacagctgtttgcaaacttaaaacatggctccaaaggagggacagcactctgtgctccatagacagtgcacacaagtccccaagtgggccatcctcttccggcctccccctaccatttgcccagacctcctgtctccagggcaaccctaccagtcccccataccagatactggagcctcgttttgcctcctcctctcccccatccccactttgggatccaccagcaacaacgttggttctgcctactcggtatctctttccactgtcccctcctccccctcctacactccaggtcccattagctctcccccagacagtttcagtggcctcctttctggtgtccctggcttccttctgtttggaaaaagcctctactctcctaggcttcagatgtgacagttgcctctaaatccaagatttggattagtggggtcaacaagatgggctgcttgagtggggtcaccagaggatgcacgggttgatggttgaccagacgttcactggtgaggcctgtttatgagatgctttgagtgggatccactagatgctgaagcaggcaggatttggttgtccctctacttgggtgaaggtgtcagatacccaggtgaggtcaggcccagagctgacttgagggagctgaggccagaaaggggctaagacgcatctgtccacatccctccatttctccctctccacccaagggtccttgaattcccagccacagccccctccctcaccccactttgtatgggtctctggggcaattccagaaagtcgtcttctgcccacttcagcataacctgggactttatcccggctccaccacttactcccttggaaaaatgcatttacttacttgggcttcagtttcctctctgaaaaacggggcttttaaatcctcctagctgaggtattgggagaatcagttgaaagtccctccgaagactttggtgctatgcgcaggaaatacatgggccaggggtcactttctctctatccttccacccctcccacttgccccacactctgagcatttgaagggagaagaccttgtcttgttcctgagacactcctcctaccccatgcctggcccaggggtgcccagaaatgttttctgaattgaatcaacgaagggagagggtgttgggaaacaagcagggccctggccaggacatttagacctggggtagggacaggactgtccctcacagtcccaaacacaccttttcatcctgtcaatgaattttggctttcaagtcctacagacctgggttcgaatcctggcccagctccgaggcctggcacaaacgatctcaagtctgcaagcctcagctcctcgtctgcaaaggctgtggagcgatctccagctcacaggggtgctgacacacagtaggtgctcaggaaatggcacccagcccatattcctccttcccttcctccttttcgcctttcctttcttccatgtgagagatgtctccaaggaaacaggaggaattatttaaagaaaagagccgaggactcgggtgggagcggatggtggctcgggcatctggaaggcagaggcaggctgcactggcccttcaaggagacaatgggacccaggtgcctcctcatctcagacagcactaggcagggcctatggcaaatctatgttgaggggcagtggaaaaatgctcctggcaccaaagagcaggaacagagcaatggaccctgctctgcatttgccttacttggtggccctgaaaaagtcccagccctccagccttgtggcctgggggtgaatgggaggtactactgcaagggaggtgggcagggagaaggtgaattggggctggtgagttccgggcttagaagagtaaaagtgaaggtctcagggtgctcctgagctgggcagaaattcattcattcattcattcattcattcattcattcactcatttattcattcgttcaactcatatctactgaactgaacaccttcctcctctctgccaggcaatgagcacacctcatttcacgttttcctcagaatatccttgttatgagatttttgcccccactgtgcagatgaagaaactgaggctctgagaggcgaaatgaatcacccaagtccacaaagtcaaagattcaagcagggcacggtagcgtgcacctgtaatcccagctactggggaggctgaggtgggaggatcacttgagcccaggagtttgaggctgcattgagccatgatcatgccactgcactccagcctgggctgcagagccagaccccatctccaaaaaaaaaaaaatcaacagttctttcccagccttgtcctcattttctatagatcactatcaccttcaataaaaagtcctgatgccttgagaggacctcacggtcatgatgatccagcccctgccaacctttctggcttcacctttgagctctccaggcttccgtctcagtgagctgccagtagtggctcagatgtgccccagcctggcctccaggtctctgagcatgtccttacgctgcaacgtcccctctgtcttccccttgctcttcaggctaagtcctgcacagcttaggggtcacctcttcctgtaacccttctgaccctctcccaaggctcagtcagtgccctccaggagtggtgggttttcttgtgtctcctccgtgggcagcaagccccttgaggccagtgacattcctcatgcaactctgcatccctggtacccaggaggggctggacctgggtgggtatcagtgggcaccaagtgagtgaatgaatggatgagataaggtacagtgtgaaattgctactcctagcctcaatcattttgttctctaaacatttcccaggcacctcctccatgccaggcctgatgccagccccggggaagacgataactcagccttgcaattcactttgtggttcacaacgtgcttccattataacagtcccagccaccctgcaaagtagatgtttgtgttgttttgggctgtgtccattttttgaatgtggaaactgagacccagtgaggttgggtaacttgcccagtcacagccagtgtgtgacagagccaagatatgaatccaggcctgttcactccagagcccacactcccccacaccgggaaaacaaatcaaaatagagcaaaggaatacatgacacttagaaatttattttggaacaaatttggacaatatagaaaatttggaaaatataggagaggagaaaaaaggaggtaattctgcatagctcccctcccctgggatacatgtcattaagtgtcattaaaagtttgagaatcttctgcttgttttggctgagcctggccaagttcatatgatgcaagcagcacacggtatgaacccagactgtcaaatgctgcctttttaaatttttttgaggcagggtctccctcagtcacccaggctagagtgcagtggtacaaacacggctcactgcagccttgacctcctaggctcaagtgattctcccacctcagcctcccaagtagctgggactacaggcatgctccaccacacccagctaactttttaattttgtagggatggggtctcgccatgttgcccaggctggccctggactcctggcctcaagcagtcctcctgcctcagcctcccaaaacactgggattacaggtataactgtgcaggtctcaaataccatgctttgatattaatttaatgtggcctgaaccccaaggagctacttccagtcttgtgggagaggaggaagtaacaggtgtgcctaagcgggggttccccctaagtggaccctgaaacaggcacttgagtgcaggtagtttatctgagaggtgatcctagtctgcaggagggaggcagaggaggagggaaagtcagtcagatgggcatttgccagcagggcaccactgtgggccactggagctccatcttgctggggacgttctgaagaacagtggaaagcgtgcctgagactgtctccctgaaggctcggaggctgcagcatttcctctgtgactcttttccccaagggactgaaggttctgctgggggccttactctcctgcatttccaagccgtcctgtgcttggatgggacaagctcttgcaacttcagaaaatgccatcaggcagaaaagtggagagacctggtgggtgcttgcagcagaccagagttcaggagctgtccaccaaggctgcagcagaattcaagatgggcaccaacagcatttgctttgagacgtggtgtgtctttgtcatcataaagtgttttgggggtataaaaccaggaatgagacatagaatgagacatagaagtcaggggtgatttccccagaataggtgacattcgagttgaattttgaaaggtgactacacaatgggagaagaggcatttcaggtaaaggctgaggtgtgaaacagcttgttgtcttcaggagaaactgcagagcttgtacctgagtcatggggtttggccaagactggtttggtacaagctcaatgtcatcattagctagatatggtcattatccggatttaatcattatcaaattacagacctggtttatattccactttcactgcatctctgtggacctctccatctctttttctgtctttgtctctatgagtttctctctctctttttaaaaatacatacttcagatacacacaagtgagttaaactgagtccttggttcatgacatgccttcagcattggtgcatcaagtcctacagtgtatataatacaagatagtagaaagcataatctaacatatgcaccttgagccactgctcaccccaagaactagaacagaatcagtatctgacatctgcctctgtgctgcaccccatcccatcccccagctctctgctggaggtcactaagattctgaattttgagtttatcctcccctagtttccttgtttttagtgttattacatgcatgcatacctaattaatatgtagtttgtttttacttgtttattaattttatgttaaaaagtgccatactgtatatagtcttgtcttttctttttagctcaatgctgttgatgagcatgtggccatgttgctgtatgtaatcatgatttatttgttctgaaggctgtatgtgactataccattatttatttctttttttattctcccgtcgatggacagtcaggctgtcttctggtcttctgctattgcaaacagtgctgtgtggctgttcctgcgcgtaaatcctaaagctctgcaaaatgcagtctgggcatcctcagcccgggcatcacctggaaacttgttagaaatgcagagtctggggccctgccctagccccgccagaactgaatctgcattttaacaagacccctgggggattcactggcttattcacgtttgagaagcactggccgagtgtacctctgcatgggtttctcttgggcatacacatcaggagtggaagtgctgggtcgcagtgggtggcccagatcaccctctcggccgcagcttcggagctgccactgagctagagcttccccagctcttggtattgtcccacgttctcattgttgccagtcgactgggcgtgcagtggcatctcatcatggtcttgacttacatttcccccatgactaacgaggtcaggcacctcctcgtatgtttactggccatatgtttccccttctgtgaaacgcctgttcctgttttttgctcttttttcttttaggctcactctactcaatcctgcctttgcatatactgttctttccatcagaaatgccttcccctttcgctaccctgtgtcagttcttccaggaagccctctctgattgctgcttaggttgtgagcctcctcagcctcacaggcaggaaaactcggtgtcattgtcccttcattcttctcctgaagtctcttcctcactggagagactgtgaacctatatggcttggtttgcatagagttaacaattttttcactctagttgccattattttcagggattttctgaagttttacatttcagaaaatcttaactgctagcttctcttgaaaaaataagatatggctccactgtctccttccctagatggcaaaatcagctagtgctgagtaggggctgcccctgctggaccatgtgtcacagtccccacaactccaggctcacaacttgcttaaacaacctgtccaagccctgtgggcatttgggtttgtgacccttgcctaagcgtgcccaatgcttgttcctctaaaacttgcccttccttcccctcctccccataaccccatccttgttcccactcagggctttgcatctctcccctgtgccatcacactagcctccttgacattcctttctctagtcttgcctgttccagtccactgccatgtcacactcctgctcaagaaccagcaatggcacccccttgccttcccaggcaccacctgactttctacaaaacaaaaaagtattacaataggaatattttatgtccacaaaaaagtctagagaacaacatgacaaacacccatgtgctcaccaccccggcttaagacataaaccacttcaagtatatttaaagcccttactacaacattcccttccctctctccctcacggtcactactctcttgaatttgctgtctatcactcccatgcatgcttttacacttgtattacatatgtatgtgtcgctaaacaatatatggtattgtgttgtgtgttttcaaactttatgtatctggcatgaaattatgttttccatctgcaacttgctttttccatccaacaatatatatttttattttaaaaattgtattgaagtatagcattcatacaaagagcacacaaattgtaagtgtacaaccctggattttcacaaactgaatcaacagtgtgtttttgagattcagcctcacaatgcataagcttgcaatcacctattttgaggattgtggatcacagacagttttccattgtctgaatgtgttgctatttatccagtttccaaatgatggacatttaggctgtgtccagcttttcactattacaaacgatgctgctatgagcatccttgtgcaagcctcccgggcccccatgtgaggtgttctcgagggcaaagcctgctcatcttcaacctgatcatatatataccgccaggtcgctgtccagcccctggctctcgctggctcccagctcattcgccaagatcttcccactgctccagggagcccactctcctccttgctgacaccctgcccaaacatgccacctctttgcctgctgcatgcaggtgttaaactcacctttccatccaggctttactgaagccctgcctcttccaggaagccctcttgggcagcgctgggcctcagggtgtcatctcctctgagtgacctcctctcaccccagttgttagagccagagaagatagagacaaacccagaccagacactggggaaaggggaatgtgttctggagaaaggaaatatgggtagactagtagggagtgtgagaagctggggtacgaaacagattgctctgggccttgatggatgagtaggagtttgtcaggtagagaggtgggagggcatggcaggcacagggaaaggcagaggctgggcactgaaacagtcatcactgggttggggatgtgagcagggtgggtgggtggtggaggagactggaacagggctgtgaggagccttgcaggccaccctttcacgccattctgacccttctgcattcagaggcattctctggagatggctgtgtgtgggagccagagaaggcaggcacattcatttgacacctactgaatgccaggcaccggtaaagagctcatacccatgatctctttggtttctcacccaagttggggatagagactcgtggtgtccccattttacaggtggaggaatggggctcagagagggacagtcttttgtctgtaaccacagagccaggagaggcagggctggtacgcagttcaggttcatcccactccagagactgcatttaacccccgttcagccagaggctagaagacacctgggagagggttctgcggaagcaggtcaccgggagggggcacccattcctagaggcaggagccccaagttctcgggggtggggtggttcctgactggcgcggtgtgacccgggccagtctcgttctctctgggcctcagtttccctcctccacggggcggcgatggtcaacacaggttcctgccggcccgccccgtagcctggggttccaggctcccgtgccaccgcggcccgcgctgtgtgaccttgttccagtagcctgccctctctggactggcggccccggatttccaagcgctcttccggatcgcgacagagcggtcgcccgctgcggagaccctcccccttcccccgggttgcgggggcgtgggtgggggtggggcgccaggaacggcgcgggcccccccaaggcccccccagccccgcgcccgcggcccgatccgcgcctggttttgggcgcagccgcacggccccctcccccgcgctcctctcccctctccccgccccctccccgccgctctcggggagccggggccgcacggctcctcctcccgcagccgcatctggggcgccgcgccggccggaggagaggcatggggcgcccgcgggccggagccggggcgggggccggggcctaggcgcgcggacctgcgagcggacccgagaggcggcggcggcgcagcggaacggcagagcgggccggaggcggccgaggcgcccggcgcaggtgagggcgcgggggtggcgcgcggcggctcctacccccttcccgggccggcgcgctccgtccctcggctagaccccccgatctggtctcctccccgacagacctccctgaaccgggggacggcgctggcgcagaaaagccccctcccctgccagttctgtcttccgatcccgggtccgaggggccggctgtgcggctgggaagcgccttctccggttgggatcgccccatccatgtctccccggaccctcaaatcgggggcggcggcaccggggcccggaacccctgtccgggaccggatccccattccggctctttttcccgcggactcccccgtaccccatatcaagcggctgccaaagcctggaagccccctcctcaggcccgccccctaatccgcagggcggcctgggggtcaggcggacccctcccgtgcccggccaaccttggcgcttgggagagcagggctatgccggcccgggcattcctccattcaacccagctgcctcggatcccgtctcggtagacccgggagccgccggctccccccttcccgagctctttccctgacctggcatctggggagggggcgggggcagcacccccctcccgcgctgcatagcgccccctccctgtttgcgtccctgggaggggctgggctgacccgggcacctgggctgggggggcactcacatggctaccggaggcccccacgtgcggcgccccgcggagacaggggttcgcgttcagagctggtggcggatggaccaggtggccgcggggaccagctgggtccagatgtgctgggcctgctggaaggggacaggtgctacctggacgtgtaatggcccttggtctcttttggccgaacctgccgctccgatccccctccatcccttcatccctccatccctccatccctccatccctccggcccttctccccttcttcctccgctgcctgtgttgcagagaggggctgtcagagactgttgatgtgggaaaaaatgaaatgggggaggggttgtgattggcaaaggccagttgtgccgggagcggtgggtagaggaggtgccctgagaatgggaagccctaagcttggagggcagcgctgatggggagagggttcctggcacccccacctgcctggaagtggaaatgacatagcgggagggggctgcagttccagcccccgggggactggcctgccctgcctctacctccactgcacctcctctccaagcctagtccccagtagggaggggggagtcctggctctctctgcctctgagccctcacttgtgggagggggctgttttccgccagctggaagtggtgggaatcagttgtacaggaccatctcctagaatgcctgttggaagagccctgtttctgtccctccttggtggccacctctctcttgccttctctgccagagggcactgggctgcctggtcccagggtggggctgcagagctggtgccctggcctggccgatgggtggctggagtgttggagccaccaccaggccctagagccggctgtcggggccagtcagcagcagactccgagtgtgttcccagcagctccggagacgctggctgtgcacgtggggctggctagagtgcctgtctcccgctgtggcaggggtaggccagggatcctgtgtcctccaggagctgggacagcgcaactcaacttctgggagtgtgcccgtgtgtggtgtccatggcgaccccgtactcacctgccagaggcctggtgaggcctgtgctgggcgctggggagtgcaatggctgacagggtccccacctccaggagcctcttttttgttgggggaggcagcctgtgtcaggcattggagacagtgtccatgctgaagagaaactgtgagctggacgggacctgatggctgggttatgtggaaccccgggtgccagccttgagatggaactgcaggtctgagggctgtgccccgggcgtgaagctgcctggcagctgagttggtgtttttgaaggaaggctgtgcagcacttgggaactaggagagaatgtgtgctttggagctttcgggagacgctgacgtatcggatgtatcggggcacccactgacatctcattaggttcttgtgtggtttgtgagccacaggcttcgtaaatgccagcagtttcacatgatggggaggctctgaggaactgtatcccgggcaccgtatgtgacagaagcaggtggtccctaccctcctatacttccgtgatgggtattcattcattcagaaaagcattagaaaatcgcatttgctaacatcagtgcatttgaacactttcatttaaacattctgaaatgtgaattaataaaatcttgaatgcagggtttttttttatagaaagtacacagtaggtactcaataaatgtcatggctcccaggatgaaacccaacctccccctcccccaactagctactttctagccacctcttgctccccaccccctccctctttggctcgggtccccctggcgggccttcagttcctggaacaggccacgttccctccagcttcagggtcttcacacatgctggctcctctgcctgaacatccccagcccccttctcccacgtgcctgtttcactactgctcatcacccaagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcttaaccactgcaccctcctgccttgggtgagacagacgagggcagggaggctctggctgggtggggtcttcatgcctgtctggaaatgaggtgttcatagcagtgattgttgatgactagctgttctaatgagcaggttttttctgattttgtttttcattacaagagcaaaactgaaggcaggcgcggtggctcacgcctgtaatcttagcactttgggaggccaaggcgggaggatcatgaggtcaagagatggagaccatcctgaccaacgaggtgaaaccctgtctctactaaaaatacaaaaattagctggcatggtggtgcacgcctgtagtcctggctactcaggaggctgaggcaggagaatcgcttgaacctgggaggtggaggttgcagcaagttgagattgtgccactgcactccagcctggcaacagagcgagactccatctcaaaaaaagaaaaaaaaaaaaagaaaaactgattggaaaggtgggcatctgtctcaggcccggagggagggagctgctgattttgaggggtggcccaagtttgagtccccactctgctcactggctatgtgattttgagcaggtcacagaaacctctctcagcctcagtttcccccgctgtcctcagagggataacagtgtcattgcctgtctcagaggcttggtttgagggtgaattgaggtcctgtgtgttcaaggactgaggacagagcctggcatacagcaagtccccaaaataaggcagctggtgttactgtgctctctcctgacacccgcacaccccccggaaccttctggcactccctccctagcctagcccagggcagctcacagaagggccagcctgggaaagtgggccaagggtgagcactatgggcagagccctgcacagagggcacagtgcttgtccccatctcacagaggtgggaaaccggggccacagatgactggtccaaaggcctcaggggtggagcggggactggatcacagcctcgtgactcacagtccagtgcctttcttgctgcccaactccttagggattcttgggagaacttcaaggagctaaagagaattctaggggcccccagggcacctaggaggcctgggaggcaggtgcttgggccctcctcccctcaccaccccaggcctctgtgtgaccctgttggagttgcctccttctctgtgcctctgtcacagcaaggtagcggggagagtctggaatctgaagaacttggattcaaggccccctcccccgggcctccctctgcgtcccactcccccgggcctccctctgtgtccctctcctccaggcctccctctgtgtccccctctcccaggcctccctctgtgtccctctcctccaggcctccctctgtgtccgcctcctccaggcctccctctgtgtcgcattcccctaggcccccctctgtgtcttcctctcccaggcccccctctgtgtctttctctcccaggcccccctctgtgcccctctcccccgggcctccctctgtgtccccctcctccaggcccccctctgtgtctccctctcccaggcctccctttatcccctcctctaagccctcctctgtgtcccccttccccagccccaccccgtgtcccctccctcctctgctgtcctggtttgtgcctggccgacattcaaggtggcagctttggggtgggagctcaggcaatgggaaccatgcttggaggggcccagccaggcccacactgacccttgccctggtggactccctctgccagggcaggtggcagtggggctgtggggctgtgagtgggggctctggttctccccacgctgcaggcctgcgtcatgccccccactcccttgctgcatgccctgcattggaaagcagatatatttagacgaaatgctgtgttccagacagattctgcatccactgtacttgtcagggctgggggaggcagggcctgtgagcagccacacctggtacctggagtctgggcccccctgagccctttgcccacctgcctgggacctctgggggctgctgactgggtgagggggacactgatgagacagaggcctggccctctaccgactttggacgggtctccctctgcaccctctctgccgcctaaggccacatctctctaactctttacctccaagtcacagccaaatcagtccttggctccctgtctgcccccagcttcctctgaatccccgaaccctcctgtaccccttccaggactcagcactttgtcccctgtgtagtcagtcagcaaacgaggatttgagcctgctgcgggccaggtccttgctggatgtaggacctggagatgaaggccctcaaaggagccacatcacagtctaggagcgggatcatagaccacaaagacaacagcaggtacccgcatggcagcaggaagccctagggcaagggcacccatgctggggtgatggtcagggaaggcttctcggaggagggagtggtccaagctgacacccgttggttaagtgagagtgagcccacacctggagacgaaacaggcattcctggcagagggaacagcacgtgcaaagggctggggttgagggaagacctggctgcacatgggagaatagggagcaagaagacgggcagggatggggtctttcagagcctcaagtgccaggctgagggcctcggctgccccatgggccctggagggctgcgggggagtttccagcaaggcagtggccaggtctgatgtgagcatagctggggcagctggtcattggttccacagccactcgccaggctggccccggcttccacctcggatgtgctctgcccagcctggtgggaatcagaaatagctcacacgtgctcagcgcctggtgaggcgctcgcccgcctcagcgcgtttcatctgcgcccgagtctaggagggctcagtgcttgtgagctgggtgaccttctcactcctacttattaatatgccacccactggggctgtaggcagagttgggagaacgagcatggggagggagcgaggagggggaaaggtgggggtcccagggtgggaaatgctgagggcttggaaatggtacctgcccaccagaacaatatgcagcagataaaacccaaagtatagagacaaatatacagatccccctcgatctacctgcagtggtgaccacattttgatgccgaccttccagaggtttctccaagtctgtctgctgtggcagatagattcattcattcattcaacaaatatttgttgagtgcccacttgatgccagaccctgtggtgggcagaggggacatggctctgagtgaaagggactctcctggcccttagggaactcaaaaagcaggtaaaacagtgatgaggcccacggaggagggtcacaggaacatgggccctgactggagtcacaaaggcttcctggaggaggtgacacttgaactgagacctaagggatgaggagaagttgccccagcaaagaggagcagaagaaaacattccagcagagggaactgcaaatgtgcaaaccccggggtgtgaggaaggtggggttttcagggaagaggaaggaagatggtgaggctggagtgttgggatgtggagggaggacaggtgaagcactagaggatggcgggggccagacggtatggggccttctgcactgtggtcagggtttggggatttacataagagcgtgggttgtggcgccagaaggtctagatgcaaatccagctctgctgcttattaggggcttgacttcagcaagttacctaacttctctgtgcctcagtcccctcatctgtaaagtaggggcagtgatggtccctgcctcataagactgttgtgaggatgaagtgaggtaataaagtgcgtaggacagcacgtggcacacagcaagtgcttataaatggtagctcatataatgtcacagtcatctgtagatggagggcatctgtgcagatgactttgcaatagggtcacattagtcctgctcatctgcagctacttcttcccttgatgctggccatcctcctgagtcagtgactaccgagtattattctatttgaaatttctgagttgtagtatagcacgtgttgtagagtgtactaatcttaagcagatagtatagcttgatatatgtgtatatctcacccttgtaactaccactaaggtcaagatgcaggatatttccaggccaggtgcagtggctcacgcctgtaatcccaacactttgggaggttgaggagggtggattgcttgagcccaggagttcgagaccagcctgggcaacatggtgaaaccccatctctacaaaagatacaaacactagctgggcatggtggtgtgtgcctgtggtcccagctactcaggaggaggctgaggtgggaggatcgcttgagcctgggaggttgaggctgcagtgagccatgttctcaccactgcactcagcctggagtgacacagagaccctatctcaaaaaaaaaaaaaaaaaaaaaaaaaaaagatataggatatctccagctataccaaaaggctctgtcttgccttttccaattaattccccacctcccttccccaggggcaaccaatattctgactcctaaagccatagctttgttttgtctttttcacaccttcacataaacaacatcatgcagattgtctcttttgtgctaacttcttttgctcctcactttgtcaatgagattcatcatggctgttgtgtgtattggtaagttttcttttatattgctgcctagtattccacttagcgaatatgtcatacgttatccattctattgttgatagacttttggaatatttctagtttttgactatatggatagtgctgctttgagctttctcatagaagtcttttgggaaacttttgcggttatttctgttggttatataccgagtggagtttatttattctgtgggttgtctcttcacttttttgatagtgccttacagcagggatccccaacctttttggcaccagggactggtttcatggaagacaagttttgggatgaaactgtttcacctcagatcatcaggcattagttagattcccataaggggcatgtaacctagatcccccgcatgcgtagttcacagtaggattcgtactcctgtgagaatctaatgccaccgctgatctgacaggaggaggagctcaggcggtaaagctggcttgcctgctgctcacctcctgctctgcagcccagttcctaacaggccacagactggtacaggtccatggcccaggaattggggacccatgctttatagcacaaaagttttaaactttgatgaagtccaattcatctattttttttctttgggtgtattttcttttggtgtcatatctaagaaacagttgcctaattcaagggcatgaatatttatgcctgtgttttcttctaagagctttatagttcagctgggcacggtggctcatacctgtgatcccagtactttgggaggctgagatgggaggatcatttgaggtcaggagtttgaaaccagcctggccaacatggtaaaacctcacctctactaaaaatacaaaaattagctgggtgtggtggcgggcacctgtagtcccagctactagggaggcagaggcaggagaatcacttgaacccgggaggcagaggtttcagtgagccgagattgcaccactgtactccagcctggggaacagagtgagactctgtcaaaagaaaaacaaaaagagctctatagttctagctcttacatttaggtctttgatccattttgagttatttttttgtgcctggtgtgaggtaggggtcaaatttaattattttgcatgtgaacaataagttgtgctggcaccatttgttgaaaggactgttctttctccattgaatggtcttggcacccctttcgaaaatcaattaaccataaatgtgagatttgttgttgtagttgtttgtagatcctcagttctgttccattgatctatccttatgacagttccacattgacttgattattgtagctttgtaataagtttcgaaacttattatcttttaatatctgtagactctgtagtgatgtgacctgtttcattcctgatatttgtaatatgtgtctgatctttctttctcatttttaatttttgatcagactgggtacatatttttcaatggtattgatctttttgaaggacagcttttggtgtcactgattttttcttattgtttgttttctcttttattgatttgctgttctgatgctattttctttctcccacttagttcagggttaatttgtttttctttttctagttttgttttttttaaggtaaaagcagaggtcattaatcttaaagcttttgtcttcatgaatataggcatttagtgctataaagtttcctctaagtactgctttagcagcaccccacacattttgatatattatattttcatttttattcagttcatagtactttctagtttcccttttgcttccctctttgacccatgggttttttagaaatgtgttatctaatttccaaatatttgaggatttttcagggatctttctgttaattgtttttagtttaattccactgagattatataacatattttgcataactttaatcttctaaaatgtattgagacttgtttaatggcccagaatctggtccatcttggtaaatgttccatgaaaagagtatgtattctgttgttaggggatggagtgttctataaatgtcgggtcaagttggttgataattttcaaatcttctgtatccttatttattttctgttcacttgctctaccaattattgagagagagctatagacatctctgactataattggagatttgcctatttctccttacattcctatcactttttgctttatgtattttaaagctttgttattcaatacatacatatttaggatcatcattcctgttgttgcattgacctgtttatcattatgaagtgattttataatattacaaaatatactttttttttttttttgagactgagtctcgctctgttgcctgggctggagtacaatggcacgatctcggctcactgcaaacctctacctcccgggttcaagcgattctcttgactcagcctcctgagtagctgggattataggcacgcaccaccatgcctggctgatttttgtatttttagtagagacagggtttcactatgttgaccagactggtcttgaactcctgacctcaggtgatcctcccagctcggcctcccaaagtgctgggattacaggcatgagtcactgtgcctgtcctgaaacagactttttctgatgttaatgtagccctcaagattttaaaattggtgttaacatggtctatattttttcatccttttactttgtacctgttcgtgtttttatatctgaagagcatttcttgtaggcagcatatgtcaacataccaaaatttgcaggatgctgttaaagcggtactcaggggaaacccaataagttgggccccagattcaccccaggtttaaatcttttctcttgctatttgttttctatttgccctatctattctttgtttctcttttcttatttttctgctacctttagaattaatcacatttttgttattccactgtatctcttgttaattatagccataactgttttattttagtgcttgcagtatggcttacaatctacactttaaacttattgcagtgtactttcaagtgatattatatcagttcatgtatagtacatcacaatagcatacttccatctcttcgatcttgtagtattattattatgtatttgacttttatatgtgtaataagcacaacactacattgttattgtttttgtcttgatggtcattatcttttagagatatttaaataataagaaaaataatcctatatatttacccatgtagttattattttcagtgctcttcattcctttttatagattcatatttctctctggtatcattttccttcagcctgaaggattttaacattccttatagtgtgagtatgctggtgaggaattctttcagctttaatgtgtctgaaaaagtctttattttgccttcatttttttaagttatttttgctgggcatggaattataagttaacagatttttttttctgtattttaaagttgttccactgtcttctcacttgcattgtttttgacaagaaatatgctgtaatgtgtatccttgttaccagtatgtaacacatatctttcttttctggctacttttaagattttctctttttttttttttttttttttttgagacagtctcactgtgtcacccaggctggagtgcagtagtgtgatctcagctcactgcagcctccgctacccaggttcaagtgattctcctacctcagcctcccgagtagctgggactacaagtgtgcaccattacacctggctagtgtttgtatttttagtagagatggggttttgccatgttggccgggctggtcttgaactcctgacctcaagtgattcacccacctcggcctcccaaagtgctgggattacaggcatgagccaccatgcctgacctaagatttactctttaccactggttttgaatgctttggttatgatttacctccataaggttttcttcatattttttgtccttgggttcatttagttcctgaaatgtgaagatttataatttataattttacacctggcagagtgcagcacaggaaacgagaggaagtgtcagagcccacagcttggtgaaggccactcttgactcagtttctctatccatctgctaggccgagggatacctgcattccaggacattcctttgttccagataagaattatctggttaaattctttttttttttttttttttgagacggagtctcgctctgtcgcccaggctggagtgcagtggcgggatctcggctcactgcaagctccgcctcctgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcaagaattatctggttaaattctaaggttgccaggcacagtggctcacgcctgtaatcccagcactttgggaggccaaggcaggtggattgtttgaggtcagaggttcgagaccagcctggccaacgtggtgaaactccgtctctactaaaaatacaaaaattagctgggtgtggtggtacacgcctgtaatcccagctactcaggaggctgaggcaggagaattgcttgaacctgggaggtggaggttgcagtgagctgagatggtaccactgcattccagcccggacaacagagcaagactctgtctcaagaaaataaaaaaaataaaaaataaaaattctaaatttaaagtgcacattggcaaagtggccagtgtgtcaggtggttgggtgtgccccttaatttgatcactcagcttctcctgggcatcttttgtgctgagtagggcgtccagctgggaggacatcagaccctgacaagttgggccccagagtcaccctagaagctaaaaatacacaatgagattaaagaaatgccattataaacagcaatggttcatcttatttgtatacaaaactggcaggtttttttttttttttaaataaagtccagcatagacaagaatgcagggaaattgatcttcccagactctatcaggaggggtataaatcagaatcccctgcttttgtagggcaggttggtacaggattgtcacaaagtttggggggttttattgtttgtttttttgtttttttgagacggaattttgctcttatcgcccaggctggagtgcagtggtgcgatttcgtctcactgcaacctccacctcctgggttcaagtgattctcctgcctcagcctcaggcatgagccagcacacccagctaattttttttttttttcttaagacggagtctctctctattatccagatggaatacagtggcgcgatcttggctcactgcaacctccacctcctgggttcaagcaattcttctgcctcagcctcctgagtagctgcgactacaggcatgcgccaccatacccagctaatttatatatttttagtagagatggggtgtcaccatattggccaggctggtcttgaactcctgaccttgtgatctgcctgacttggtctcccaaagtgctgggattacaggtgtgagccatcgcgcccggcctaatttttgtatttttagcagagacggggcttcaccatgttgggcaggccggtcttgaacgcctgacctcaggtgacccacccacctcagtctcccaaattcctgggattacatgcgtgagtcaccatacctggccaaggttggaattttatctatgtttggcctggcaatttcagctccaggaaattttaagaaaacagttcagattgttggagccaaacagtcatgagtttgaacctggatgtaccacaggtcaccagttatgtgacctgggactagttactctacctttctgaagtttcatttgcttatctgtaaaattgggattttaatacttatatcatctggttgtagtgaggttaactgaagtaatgtgtgcaagatattcagcttagggccagacacagcgcaaaccttgtgcccctgggggatgtcttgatgacgtggatggaaaaaactgagtcagaagtggcctccaccaagcttttggtcctgacacttcctctctatccctgattatgtataggaaataaaaaggctgagccggacacagtggctcatgcctgtaatcccagcactttgggaggccgaggtgtggggatcacttgaggtcaggagttcgagaccagcctggccaacatggtgaaaccccatctctactaaaaatacaaaaattaggccaggtgcgatggctcacgcctgtaatcccagcactttggtaggccaagtcaggcggatcacaaggttaggagttcaagaccagcctggccaacatggtgaaaccccatctctactgaaaatacaaaaattagccaggcatggtggcagatgcctgtaatctcagctacctgggaggccaaagcagaggaatcacttaaccggggaggtggaggttgcagtgagcaaagatctcacactccagcctgggtgacagagcaagactcttgtctcaaaaaaaaaaaaaaaagactgaaagacacacaccataatatcagaagcagtcatctctgggagaataattttattttcctaatgccgttctgttttcttccagttttctacagtgaacatatattgcttttgtaacaagaaaaaaatgacaattaaaacacagtgtgtctcgttcttccagagcctgcctttgaaggagtgaggagcctgatgggccaggccagaggagggttttgtgggggaggttctgaccatattggtgggggctccaactatcgtggtgggggcggcaggactggagaagggctaggttactgcccctctatgccccaggctagagccaaggttggactctgagtggagattatggagggaggtggtggactatatggcttctagaggtggacctatttactctccgtgggacctcagctcagtgccttcagttctctgtgccttagtttcctcatctgtaaaatgtgcctctatgggacctacttcatagggtagctgaggcttcagtgacttttgggattttttttttttttttttgagatggaggaaagtcaactcctttcccctctgtcacccaggctggagtgcagtggtgtgatctcggctcactgcaacctatgcctcccggattcaagcaattctcctgcctcagcctcccgagtagctgggactataggcgcccgccaccacacccggctacttttttgtatttttagcagagacgaggtttcaccgtgttagtcaagatggtctcgatctcttgaccttgtgattctgcccacctcagcctcccaaagtgctgggattacaggcgtgagccgccacgcccggccgacttttgagtttttattttgagtttttatcacagtgccttgtggaccgtaaatgttagctattgtcactgttgttgttgttattattattattactattatgagtatcatcatccaccattcccttgcttccaattcaagtggtgaggagagagggctgggctgtccctcacaaagtgggccatgtgagagagacagctcatcccccctgggggcctgtggggggaggccaccccatttccctgggccttggcttcctctctcacctgtggggatggctacttccacgtggtgagaaataaatgggtcctcctgtccagtgcccacactccaaagatgcctattgagcgtctgctcccagcccttcagggaggacccatgctgtcagaaaacgaggggaagagtgtgagaggccaggtgggagggccaacttggggtcaggtgcccagccaccgggaggcccatctccggcatccccagctgcccctcctccagctcaccgatggccttggagggagcaggaccaacatgggaacattaatccacctcattacctccctttgctgtggagttgtagcaattagacctgcagtctgggcagcattaggagccaggcaggggtcacccgggctgctggccccctgccgacccagcctcagcctggactcactctgtctctggggagaggggccagagaagggagttccctggcagcagaatctccctcatcactaaagatggatgcagagatggaagctttggcctcttttcacttacccactcacaggtgtttaacagatgtttatggagcacctactgtgtgccctggagacagatgtggtccctgccctcacagagctctcaacaaaagtaaaataattgctgctagtataaatgctgtgatggagagcagcagggtgacaggtgtctgctggggtggtcagggagggcctctctggggaggtgacatttgagctgagacctgaacacttacaaaggagccagtcttttgaggatctgggatcgggtgggggttccaggcagggaacaaactggggaggttgtgctggcggacatgttcagatgcggctggaaaagagtcgggggcgggtagggggagatgaagtcagagaaataaggacagggggtgcgtctagccataggaaggacatgggttttccctgagtcaagccagagaccttggaaagcttggagctgggaggtgatgtgatcagattcatgggcatgagacttcctctggagaagggatgcccaggagaaggctgggccagtcatctggacgggatggagaggatgaggtctgggtaggggcaggaggctgggctgggcaagggattcagagccttccaatgagtccttcccagcctttgagcctcatcctcttcaccaagaaatggcccgatctccacggcccccctcctttcctctccttttgacacctgcagactttccctgtcccgcccgttccgttttttgttttttttgttttgttttgtttttttgtttctttgtttgagacagggtctcactctgttgctcaggttggagtgcagtggcacgatctctgttcactgcaacctctgcctctggggttcaagcaggtcttctccctcagcctccctagtagctgggactacaggcgcccgccactgcacccagctaatttttgtatttttagtagagacagggttttgccatgttggtcaggctggtctcaaactcctaacctcaagtgatccgcccgcctgtgccatcttgggtgcctcactgtgcatcatctgtcccggcagccccaggaggaggtgcccccatttcacaggtgaggaagtggagactcagaggggaaaggagttgcccaggatcagagctgggcctgcctgggtctctattctctctagcacctcccctcccatcccagccccccaccagtcaaggccccttctgagccatgacctcaattttccaaggtaaggcagcttgttagcatctcaaagaacactctcgcctgccaccatgtatattcatggagcttcaaagaggaagctccagacaggaggctctttctttccttccaagagcaaattctcaccctctcagatgcaggatgtagtctggctggaaaaagacttattttttcttctttctctctctttttttactagctagtaaaagggagatgctacctccggctcttaacgactgaacatttgttctgcctggttggtttgagaagttgtgggggcttcagagaccttggccttgcagtggattccgaggccatctggtcccactttgagggtcacagaggatggggacagggttcagagggcatcagggcagcatactcatcctgctgcaaatgcaccatgaaaatgcagctcttctccttctattggtgtgtgcttgacatttttcatactaagaagttaatagagggtttttttttctaaaacccctgagctccctgagcacctcactccgttccagccactctacctttgcccacgcttcccctctgcctgatgcgcctctgtgtgcctggtggattcccgtgcatgtttcaaggcttgattccaatgtcgcctcctctcagaagcctcccctgactccctgggtggtcatggctgtgctatgcttcctcctttatccagtggatggctttgattccttgtagcagtcctgtgaggaaactgaggcttgcccaaggctgcatagcatgggtgaggattcaaatgtgtgggttgctgtgtgactccccgcgaaccactctgcccttctgccctgcacatcacacggcattctgtaggccaggtcttcctggctgggtctgcccctgctggcctcgaagcccttcaagggtgggtccacatgggtgtggatcttgggtacccagcttcgggctgttactgaggatgcactgacaggtgtttcccaaatgggtgaaaacatagataattttccccactccctgccattatggagctaaggcagaacttgggaaactcatgggacctgcctttagaggcactaggagcaagaaacccaggcaggctggaaagccactgtccccacccagcgacccacaacccacaggggtgaccaggtatctggggagtggcgactctgtggacagcaaggatgtcgtgtgtgctgcgtcattcagcaaacacagattgagctctgtgtgccaggcacagggctgggcaccagaagcacagcggtgaacaagccagacccagcccctggcctcccagggctctcacatgagaggtggagggtgggcagaccagaaattgacaaaaatgctacagtgtggaaaacaacaattagggggttggtctgcagggcctctgggggctgggagagttatcagagacttttcagggggtattactgaggctgagctctgctggctgatggcgagctggtcagggaggtgtctgaccagcatcctgcaaaggccacgaggtgagagaatctaagctcactcagggaacagatgagaaggagtgtgacctgagggccggggaaaggagaaccattgaggtctgaggggcatagcagcggagacagggcttggcttgtggttcgaaaagccccctgtgtgtgcagcagggagtgcaatttgcaggggcccaggtggccatggagaccccacgtaggaggctggtgctgttttcaggggagatgaaggtggcctgaatcgggacaggggctggggaggtcaaggcgaggggccaacccaattttagaggcagagcctgctggattttgtactgggctaggtgaagggcaaggaaggcagtctggctgagccctggaggtgaggaatgctggttactgagattgggagttggggctgctggagacacggcagctaaggctttctttgtgaggatctccacagtggcctaggggcagctgggtcgccggcacagggtggtccctttcccccagtcctgcctctcagcctgtatctgggaccgacgtgtctattggaggtgaaaatcatgcctcccgcctgagcccgattgccccccgggggtggcagaacgccaggtgcccattttaattctccgacagtcatactgctttattgttcctatttgggattttattattattgctgttaatggtttgaaaaggccttttaattaaagctgcaggttggagctggcacctgagcccctggggtgggtgggaagaagccttgccaagcgttcaccccacctcttacagagctggaggcttttgagatgggggctgtgaagccttccatggggagactaggggaccctgccgttgagaccatggtacagccaccgccaggcctcagttctctgcctgtgatacaaccagaagattttcccagcacagatggcatgacattgatttgtaaatggacctgttggtagggagctggtgggacacacctgggtttcagtctcatctttgctgcttactggctgcaggaccttgagcaagatgcttaaatggccgcagcctctgtttgctcatctataaaatgggagtgctgagttcctgcctccatagggctgttaagaggaataaagagatgatccaacccctggcccaggctgaacactcaataaatgggggtcatgttattgtgactgtcgagactgtggggatcaagcgaggctgtgtgtctgagcctagcacgtggtagatgctccggacacagctgctccggacacatcagctgctcttatagcagatgttgctgccttctcctccccttcttcctccctcttgttcccgaacgtgcaggaggtttgacccgtctttgcctttgcacatgctgtttccccatccgtcgtgcctcccttcatcttttgcccacctggacatcctttttgacccaggtgtggagctgccccctctgggaagccttctccagctcctcctttgggacctggtttcccagagctgcccaagcatcccctcttaggggcctggtctccctgcctgtaatgacttgttgactcccaggggttgcaaactcaggggcctgcaggacctggcagatcagatcagagaggaatattgtcgagtgaaggatgacaggttcctgtttctaagcgctgctcccaccctgtggccagggccctcctcccctgcctccagagggacagttccctttagagagtttgccaatccagtccatgcccatggaacacctatagtgtgttgccctgagctgcggggcacctccaccacgaacttcctccatttccatcctcgtaaccacctacgacatctttccatgcccatttggctgacgacgagacaaaggccacagagctgaagtttctggcctccagggtcacctaggagacaactgttgatgccccatcctgatttcctcccctgaccaatattggcagctccatcagaatcatgttcttccctaggacccttgcgcttgctgtttcctctgcctgagactctgcccccagacacctgcagggcttcccgcctgtgttaaatgtcgcctcctcaaagagccctcctctcacccttctccctgctctgttatgcctatggctgtgatcacaccctgacatgttgtacatttgtttgtttaatctgcatctttcccaccggacttcaagtcagcagccctgtgtgtttggcttacatcttatctccattccctaggatgatggctggcatgagtaccagcaggtgtttgtggatgagtgactctcctaactgtgggtgtgtgtgggactaaggggacaatgggggtccagcagtcccaggggcagggaaactgggaaactggagggcccagagggcagcccccatcagctgctccccactcctctggtttccttggctgccttgatgtgcccacccttgactgtggccttgcatccaaccagagtgggcgtcagtccagctttgctcccgcctgctgtggagacagccagcccccttctccttcctggggccactggagcccagcagaccccagaggggcccccagcccgcacccagtctcccatctcagccccctctctgctgtgcgcacacctctccctcctcctacagcaaatacattttggacttaaaataaaaagcagatacggcggaggaaggcggagggagctgggggagtcgggagagagtgggtggggcccagcagcagctgcagccgcatttccccatggtgggtggggatgaccaaactcattctgcgcatcagaaactgggtctcagagaggttaagtgacttgcccaagggacaaggcccagatacagccccagcgtgatctacatacatactggaggtcaggctcacttcagccctgagggcaaagccagaaccaacaggatgttttaggggttactgctcattcgctcaataattcatggaaatgacatgctatgcccagcggcaggctgtggagggggatgggagggaagtggtgggggtggtggagggggcaaggcccgctgggtaggtgcagggaaggcttcaggttggggatgtgaaggatgagtgggcattccaagcagctggggaaggcgggaagggagtccagataaagagggagtcctaagccactcagtgctgagctgagatgggcctgagagggctgggtctgccctgtgctgtgggctctggagggtgggttcaggcacagacaggaggcagggacactggctgctcctcatggggtctcctgactctgggatcctgagggttaaatttgcagcggatgcagttgtcacaataacccctcctctgggaagcgggtgcttcccccccaggatgtttcaagcccagacttccccacccctctgtgtccctctgcagcccatggcattgtgccctttctgcctcttctggtgggagaaggcctaggctggttgttgcctgctacctgtgctgggattggtggtatgcctgtgacccctcctgatggatgtcagcctgctgggcacccacaggcccttgcctccccatccctgcctacctttagcctcaccactatgccaagagggaatggggcttggcctgtgccaggatgaggaagccgaggccccaagaggggaggggagggaggagtgggattggggagtctggaaggcctgggtctgccccagtcctgtggtccacatgtgtgggcaagtagcctgtgcccctgaacctcatggtcctcagctgcccaggaagctgggaaggttgcagggttgggaggggagcttcttaagctgtgtgtgacgccctggacacatggtgtggggagctctgtctgctgagagctgggcactggcagggactcacccacgagtgcaaggggggaggcaggagggcccatctggaggctactggaatggtagtaagaaacaccatgccgggcccattggctcacgcctgtaatcccaacactttgggaggccaaggtgggcagatcacctgaggtcgggagttcaagaccagcctgagcaacatggagaaaccctgtctctactaaaaaaaaacaaaaaatacaaaattggccaggtgtggtggcgcatgcctgtaatcccagctactcgggaggctgatgcaggagaattgcttgaacccgggaggcggaggttgcagtgagctgagatcgtgtcattgcactccagcctgggcaagaagagtgaaactccatctcaaaacaaacaaacaaacaaacaaaaaacagtcattcatttagtcatgtattgagcaccgcctgtgtgcaaggccctgggccgactggcctctgtccttggggagccgtcggtccagtaggggagtcaacaaatgacaacaaaaaaatagataaataaatgaataaatgaatgcaaccgtgccacacagtgaaaggtcccaacgcagtcggggctgggaggtcctccctgggcaagtgccatttgagctaaaccctgaggaaggagtgacagccacccaggtgaagagggagagaagggcattctgggcaaggaaacagcatggcaaaggcaccgaggcaggtggggcagagcaagcatgaaggcctgggaacactggtgagccagggagcaagagccagagggaggaggctgagaggggctggggactcagcggctctctcgggagacattgcagattttatctcaagagcagtagggagccacggagggttttaggcagaaggtaatatgatctggtgtgcattcatttttttgagatggagtcttgctctgttgcccaggctggagtgcagtggtgcgatctcagctcactgcaactctgcctcctgggttcaagccattctcgtgcttcagcctcccaagtagctgggactgaaggtgcgtgccaccatgcctggctaatttttgtatttttagtagagacggggtttcaccatgttggccaggctggtcccgaactcctgacctcaggtgatccacccgcctcagcctcccaaagtgctgggattacaggcgtgagccactgcacctggcctgttttttttgtttgtttaaggcaaggtctctgtctgtagcccaggctggagtgcagtggcacgatctccgctcactgcaacatcaacctcctgggctcaagtgatcctcccacctcagcctcctgagtagccaggactacagccaccacccctggctaatgttttttaaaaaaattttgtagagactgagttttgctccaactcccaccttggcctcccaaaacgctgggactgcaggcctgagccatggcgcccaacccagtgtgtgttttgatgtgcttattctgccccctgagtaagggagttagaggaggccagagtggagcaggggaatgcggggcacaaactcccagtgggccatctgcaggaccagcagtgtggcatttgagggggactgagaaggctgtgtttcctgtggagaggcagagccagtgctggcatttgctcatggaggggacgcacagctccggcagaggcgttaaggtgggaatggcagaggagggaagatcccagagggcctgagctctggacctccggcaagaggtgcatgctggacaggcagtggaggctgggttgggggagtgaggctaaggcagccgcagagcggggaaggagaggagcctggagtagccaggggtgttgattagcatattcatgatcttgccgcccacatgaatatgctaatcaaccctgtggggtttgggggttttttgttttcccctctgtggtagaaggaggcctaagttcccaataccctcacctctgggaacagagccccaagtatgagtgcggtaggaggggccccacatccccaacatcagctcctcccttctcctggctgcccaacagcccctgcacaccctccgtttctcgggaacttctggctgttccggaagtggagatggtgaggaaggggatgtccttgggatgcccatgccgcacccacactgcaggctgggccaaggctgcccggccccatgctgtggttccccgcacgtggctgcttctcgggagagacccgtgcacgggtctccagtgactcaccctctccgtggcacatgtggcagggagtgggtcggctcaggcaggaaacaccaggggcttgccacaatcgccagtctgtccccagtgcccccgacacctatgtgcccccagcccaggtcgggggtctctgctggcctccttgcaccctggtctttgtgaccagggaaatggccacatcagatcagcggcattagttgtgtccccacccctgcccaccctctggcatgagttcctgggcggcagggctgagtgcatgagaagaggcggagacactgctgcccagactaggcctccctctggcatccctccggagaccccaggggtcccccagttcagcctggtccctcggggggctgtcgggagccaaagagcttgatgcaggtgctgcgatccagcgggtggagggggaggcataattagctgtcaccagaggagtgagtcaggcaccactcgtagctttgagtcagccccaaaggggaaggggacacagccaaggtcacatgccagcaagttgggcctggtctccctgagcacctcccacccctccccatgctcctcctggaacaaactgggcctgctccaggcggtagctctgaggagagctgggaggcatttctatcacccattgcacaaagagggaaactgaggccagagagggcacttgcttcctctgtgcaatcctccctgtctgcacagctctctgttcaggtccttaaacctttaccaggctgctccccacctcaggacctcggcccggccatctcttctgcccagaacacttccccagttcttatccatcaagactctccacccgagtgtacttttcagaggagccttctgtgacctttgtcttgacccctggttttctctgtcccaggcccttgggacacttatcatgacttacaattgttttgccagttttgtctcacccccttgccaagagctcagcgtcctcatctgtcttgttgactgccccaaccccagcccctagcaaagtgcctggcatgtaccaacgatggtgatgcctggcactcactgatatgcaccgtgtgccaggcaccatgcaaccacctccgaaagcctttgttcccgcagtaaccctttgagagaggtgcggtttccatccttcctggtttagagatgaagaacgacgtgcagggggccacaggccttgctgaagggcacgcggctcccgcggggaggagttggtgtctgatctcccagatctgcacttgggtggcccactgggctgccaccccctcagtccctctgctctagtgcacacagtaggtgcttggcaaatattgggtgggtgaacagatgggagaacaagcttctcccagagtcacccagacatcgggggaagggcgggcctgtcgtcccagcttccgctctccagcattttcctaatgctgctggggcgccgtccccagcactcagtgggcaccaccacagcctcccgccttcctgcaggctggcagagcaggctcagctccccaggcacacttcattcgactttctcctcatttctttgagcagattgaagagtgggaacagcagcaggctgttggatcggggtgtcggggacaagagggttcatttcccaggaacccctggtggccggagtggagccctgaagtccaggtaggaggctgtgcacatagccccccaccaccctctttctgggctggggtctccccagcgaggggccaaaggtcagaactttagagccaggggcctccatacatttgctgtgtggtcttgggcaagtcactccttctctctgtgcctcagactcctctttggcaaagtggggcacaagatggctcctatctcttcatcccactgcaagaacctggaagccaaggcacggcctccagaagggataacgggagtgcttgttggctgaatggagttgggggctggatagacagggtaggccagtgagtgtgtctgggtaagggcctatcagggaaaggggagtctgtttggggctggaggcctcagcccagtaggttcccagccttgaaggccaggcccagctcccaccaaggccccatgacagcctcggtactaccaatgctgatgaatgcctgggcgccagcagccaccccgctcagtggaatcagctgtgatttatgggattggggcccgcagggagcaactgtctgagctcagagaagcctcagaaaaatgggtcaatgcagggcagggctgggatggaggtaacctctgccaactggaaaggctcagagactggctcctctgccgcatagtcctggtggggaaactgaggcccatggaggggcctttgctggcagagaggccctctagtgggcagcagaaatcaaaagccagaactagtgtccagtactgggaggtaccttatagacttcagggtagccagggaaggcctctcagcagaggcgacatttgtgctaggccctgaggcatgagaaggagccatgctggtaggaggtgagctggtggtgggagcagcaagggcctgagcttggaggtgggacagaggctggcacgttcaggaaagaacaaggagggcagggcacctgagggactgagtgagggggaggggagagggagaggatgctagagaggagcggggactgctcagccctgaggggccttctggccctcagccccagtttgggccttttcctaagtgccctggaaagcctctgaagtgccggcagctcaccggctcacattttacaaagacccctctggcctctgtgaaagtgaattggagcagcatgtggaaggcagggagtctgaggagacggctgcagacatcgtggcaacgaacagctgtggcttggacccagggtggccaagaaagacccaagcctgggagctagaatttgtccctgggattctagtttaagccactcatctcctctgggtagtgaccaattttaatgtctcaaaactgtgatcccttgatgccccacaccagggcccaggaaccgtgtttcacagagtcagtgccacatcataccaactttatgatgtgctcaaggtcacccaacttggaaggagcagagctgggatgggaagctgggtttcttagttccaccgctttttaatgcctcatttgcccctattcccaccggaggtgaaagctgcacctcctcaaggaaaaaaaatggatttttgaggctaccaggtacccccccccaaccccccgttgggtgaatttgaactatatctgtgtctgcacgcatgcatgcacacacttcactcagcaggaaatttgggacaggagcagcttgggtgcatgtctgggccttctccttgctgggaaaccaggccagagctggagaggccccagcagcactgctctggtgccaccctctccccggtactcagatgcctgctggcaagggcactggtgggccccgagtggctgctggcccgtggctacagctgacacacattgtctctgagctacttcatgtttctgcctttgacagagaaccctccagcagagcagtgggatcactactgagggagctgcctgcctgctgttccggccatgggggtgcaggggagtgctgttcaccttgccaggggagcctagcatagaccatcaggaaaaagtctgtgccgggaggtggaactgtgggttttctgggtgactcgtggtaaatcaggtccctctctggtcctcacttcccccatctgaacagtgggagtgtggtgggatagattcagtgatttcaaacctaacctggtctgaatctctgctcccgactcttcactagctgtgtgaccttgagcagttaacttcacctctctgagtctcagaatattcatctgtattcttatccccattttcgtacttactttacccgactgctgggagtagaagcaggtaaaattcttggaagaccaggcacacagcaagcacccaagcaaagtcagcctcccgaaataataacaagtccacaatgtaacagtgatggctgatgcttactgggcccctccatctaccacatgcctcatctgcacttggtcttcactacagacccgtgaggtcagtgcccttattctccccagtttacatttgagggaactgaggcacaaaagaggagctggcctgagatcacattgctggggtgtgtagagcccagccgaccatggctccctacctgtccccaggtactcatcttcctttcttaatccccaacctccagctgctcttagaagtgttttccaggggaacctggtcttgggagcctggttgggatttcagaaccttggacagctcccagtggacctgggcctcggctgggcctagggccctgggtgtgaggtcctattcagtgggatgagaccctccacctcatcttggccgtgtggaggcagcaggactctggatgagccagcaaagctaagggtcccccctccttccctaggcacatcgagtccactggacccagaggctctttgggaggggaggagccagggccctacttccatgtctcagcacctccacacccctcctgggccttgccatcaccatggaaacaggtggaggatgcactcccaaagaccccacttcaggaacttgggcttgggaagctcaggactaaatttgaagggacctaaagtcactactgcctctgttttccctccagcccattatacaagatggggaaactgaggcctagagaaaggaaggctggattcttgacatgtcccagctggaaggttcccaggtatcagctggccccactgttccattatatagacgagagaactgaggcaaagggaccatcttcagagaggtgccccctgcaattggcttctggaggaatcgctttttttccttcctcacaggtgccataatttgaagcatgtgttgtttttgtgtttggtatctcttctcctgctggtggacaaaccaaggtcagggccatttgtttgtggtcatatcccagggtctggtacacactgtggcagatagagcgttggctctggggccagctggcctaagttcaaattccagcttctgccaaggctgtgagactttgggcaggtcacttctcttctctctcaggctcttcatctgtgaaatgggagaatgatggcatctgcatcccaggcttgttttgaagattgactcagatggtataagcctcaagccttgcctatggcgaatgtacagccaatgtcagctgttactatagtcacctgttagtgggtgcccaggacgtatttgttgaatgaatgagcagaatccacccacctgccccactgtaagggcttttcttcaggacatcaggggctgcctcctcctgatcctattacttttttttttctgagacagagtattgctctgtcacccaggctggagtgcagtggcataaccatggctccctgccgccttgacctctcaggctcaagtgatcctcccacctcagcctcccaagtagctgggactacaggcacttaccaccacaccaggctaacttttttatttttgtagagacagggtcttgctatgttgccctggctgttctcaaactcctggcctcaagcaatcctcttgccttggcctcccaaagtgctgggactacaggtgtgagccaccatgcccaccctcacattttttttcattccagcagacaatgacctctcacctgccttgtcagagggccttgaaatttagcataaattgtaatcccttggagggacttgatgcgaatccctggcctcaccaagaccactgggatccagggctctatgggcagagtccaaggactgacggctgtgggtaccccatgcttgtccgtggctctggcactattgtggctgcctcagggggttcagtgaagaactgtgccatagccattgtgctgaccatgtgggtgacatagccctactcactgttagcaggagctctgccctctgggacaggcactggaagcctaagcaagatgctaggcccagagaggaaccatccgggacactctcctggaagcggtgggtttcagccaggcctgaaagagtgggacggatgttgcccagctgagattggcagatggcattgtggatgggggaacagagcccacaaagtggtgcaggcaggaaaaacaggttgtgcctggtgtgtggtgtgggatgagctggtagatgatatattgggagaagtaggtgggatttatctggattgtcaaagacttggaatgctacatcttatacaagccccttgatttcctctctctgttttccttctgtcacttgagtgttttaggacccatttttttttaattctatgaccccaatttctactcttcccctctactccagttctttcccatcacctctctcctcttaaaactcatgcataccctgacctttcaatctgtttcttatgaagtgaatccatgctgaagtcacagtggccaaaaatgagttgtcacagggctggggaggggtttcttgtaacaggggccttcagtacctcggcccaagacagagacttcggtggtggaaacttgggcagcacactggggacatttgagagaacattgacaggtctgtcactccagtgtgtggtgtgggcatttccagtcttttcctccttcctgaagctttgcctgtgctactccctgtgctgggcactgtccctgccctcagagtgctctgtctggttggggagatgtggtggtgcagggctcccagatctcctgggggcagaacctcaaggaaggctgaggatggtccatcatcagcaaccccagctcccagctggggcctgggccagagggtcattcagaagagtgctgaccccctatgtctatggacttgactagagtcaggtaataggatcagattagaagcaaggctattggggcttagagggaggaaagatggattctttagtgtgtgtggaaggggcagagagagaggagtcagggggcagatggggccagatcatgggccactgagcaccagcatcaacccaggccaagagaagcttgtttgtccattcattcaactagtatttgttgagcacccaccatgtgccaagccctgtgctggggtgctgtggaaaatgaaacatgctcacacaggcttgatggtcagggcatgaattttggcactctcatggaaaagctgtgggactctggctacaagtgacaggagacctcaaaataatgtggcttacaggttgggcaacatagcaagaccccgtctccacaaaaaaattttaaaaattagcccaacatggtgacatgcacctgtactcccaactactcaggaggctgaggcaggaggatcacttgggcccaaaagtttgaggccacagtgagcaatgattgtgccactgcatcctagatgacagaacaagacacttaaataataataataacagcagtagcttagataggatgaaaatttatttatctcccaaatatgagatgggtaggcagttcagggcctaattggtgtctccacgatcattcagaacctagacttcttcaataaagagttgttactgtgccttccatagaatggagcttcacctcatgattcctgatgactgctccagctccacccatcttatccacattccagccatattgcatgtatgacctctaagctgattttcttagaaactgcacctatgacttctgtttatatccttctaccaaaaacgtagtcacatggccacacctatctgcacaggagggagggaaatgtacactttattctagatggccaaaggcccagctaaaatcaggagttcagttactgaagaaggaaggaggagatatggggggacaattagcaatgcctgccatgctgtttcttcatctgactagaggtcattactcttcattcatttatccaacaaatatttagtaagcatttactctgagctatggccaccttttgagtgctgtgccagctgtgaacaaaaaaggcaaagtccttgctgtagcagagcttactttcttttttttttcttttttgagatggagtttctctcttgtcgcccatctcgttctaaagtggcgcgatctcggctcactgcaacctccgcctcccaggttcaagcaattctcccgcctcagcctcccgagtagttgggattacaggtgtgtgccaccatggccagctcatttttgtatttttagtagagacaaggtttcaccatgttggctaggcttgtcttgaactcctgaccttgtgatccgcccacttcggcctcccaaagtgctgggattacaggtgtgacccactgctcccggctgagcttactttctagaaggggaaacagacactaaacaaacaaataacatcaagcagtgaaaagtattatgattttaaaaatcaggaataaagagtgatatggggccaggcgtggtggcttatgcctgtaatcccagaactttgggaggccgatgtgggtggatcacctgaggtcaggagttcaagaccagcctggccaatatggtaaagccccatctctactaaaagtacaaaaaaattagctgggtgtggtggtgtgcgcctgtaatcccagctacttgggagactgagggaggagaatcacttgaacccaggaggtggaggttgtagtgagccaagattgagccactgcactccagcctgggcgtgacagaacaagactccatctcaaaaaaaaaaaaaaaaaaaaaaaaaaaaaaaaagccgggtgcaatggctcacacctgtaatcccagcactttgggaggctgaggcgggtggatcccgaggtcaggagattgagatcatcctggctaacacggtgagaccctgtctctactaaaaatagaaaaaaatagccaggcgtggtggcaggcgcctgtagtcccagctactcgggaggctgagccaggagaatggcatgaacccgggaggcggagcttgcagtgagccgagatcacgccactgcactccaacctgggtgacagagcaagactccatctccaaaaaaaaaaaaaaaagtgagatggatgtactattttaggtgtagggaacgtagcctgaagaggaggggatatttgagcacagacctgaatgaagtaagggacaagccattaatggaaagggggctctgagaagagggaacagcaagtgcaaaggccctgaggcaggagtgcgcctggtttgacagagaaacaggaaggaggccggagctgctgcagcaacttcatgggtcatcgtgaggataaaaagggcgatggatatgacgtgcccagcattcatcctggttgttcaacagataaggtacccacatgtcatgatttgcccggggcagttctggagtaattactaacagcttccttttcaagctcataagtatccctgttgggatgataaagtatgtggtcatcacatcaataaataatagctatttattgggaaactaaattccccaaggtatttccgggaaagcagcatcgccgcgtcccaggggatgggctgtcctcccctgactgccatatactcccaacccctgccccgtgtttccgccctgaaggagcagccccatcaggcacagctgtgctgatgccggcccctcatccccacaggctcccaagcaggtgagtgcaccagcatctcacagttcccacatttttagcctgtgggtctcaagcggcttctggtgtccctcagacatgtatctagaggaggtgccatggggacaggacggggatctgcacagggacccagaaggctggcgggtgccaagcctggatcgtcccccgagctcagcttgcccttaggccccccagcccttcggcatcagtttctctttgtgtgctagagacagtttccttgtggatatagggtagcggatgagtagcccagcagctgtgggaggcgggagcaagtgcctgggtgagagcagtccctcctgggtggggcagtggggtcctgtgaccttatccatccacctggccctgaggaggccccttctccatccccagcacctgccccatcctgactccgctgacactcagaattcaacttccttcaatatctcaatttgcaggtgcttaatgaaaatgcatgcctcacttccctggactgtgaaatgggcctgatagtgtccatctgtcatttccctggggtgaatcagatgatacaatggctgacaagggcatgccctctgtaccagggcagcaggtggggaaggggcctatcatgacctcctttgttccaaaaagtatcagcccaggcctctgcacacagtaggtgatcacaaagtgcttctcacagcagatggcagagatgtgatgtgtgctgaggactgctgaccagtttggctcagtctcccttttgcagatgctggaggggactgtccctcactgcctgactccttccccagtgggctgtgggcctctgctgccccagaggctgcttgtgattgggggaaggagggctgtccctgccagcaccacaagcccctcactctggaatcccaaaggcctagggagtcaggtgccacgccggggcagctgcattgttggttcagaggtatctgtgggcccagacacatctaagctttaatctcaactccagcgtgtgccgcctgccctccggcgagtgacttcacctctcacaacttccagttcctcttctgtgaaatggggatcgtaagagaggctgctccaggagtggttgggggcccccctgcctggcacagaggagggagtggcacccactgctcccactctgttgggattactgccatctttgtgccatcttttctgggagggcaagacctggggtgtcatccgtacttataaatggcagaccccctacaagaggggtccccaacccttgggccatgaccagtgctggtccgtggcctgttaggaactgggctgcacagcaggaagtgagtggcgggcctgttagatccacctcctgttagatcagcggcggcattcgattctcataggagctcgaaccctattgtgaactgcacatgtgagggatctaggctgagctctccttatgagaatctaatatctgatgatctgtcagtgttgcccatcacccccagatgggaccatctagttgcaggaaaataagctcagggctccaactgattctgcgttatggtgagttgtataattatttcattatatattacaatgtaataataatagcataaagtgcacaataaatgtaatgcgcttgaatcatccggaaaccagcccccctcatctgtggaaaaactattttccatgaaaccggttcctggtggcgaaaaggttggggaccactgccctaccagacagcagggcaggtgcaaggtcacagtctttgatttgttcgatggatatttcctaagcaattactatgccccagacactgtgctgggggctgcagatgtgttggtggggaagagaaacaatgtctccccacctggagctcgctttagaaatgggggctcctccaaacccacctgtgggtgtgatgtgctgccggccgggtggtgtgagtgctaagaggcaaaacgaccaggacaaagtgcgaggaagcccaggcaggtgagacagggtgtctggtctgggtccaggaaggcctctctgaggaggtgacagctacagaagctcaggggaatgagggagggagagaaccccgggtgatccagggaagagtggtcctggcagcggaaacagcaagtgcaaagggcctggggtggagcagctgcaactgaagaagaggtgggaggccagagttggggaaggagggcatgatggtgagagtgggcgatggcagagacgcacatggggaccagaccttgtggggccctgtaagccagggtgaggtctcagcctccactcagtgagatgggagccactgagggctttgagcagagactgtgtctcaacaggactatctggctgcagtgtggagactggactgaagggatcatgagtgcaggcagggaggccaaggggcctctaatttgggggagaggtgaccgtggctgggactcggtggcagaggtgggggtggggagggccggctggattctagagatgttttgaagggaagagaagcaggatttcctggaggactgagtgtggggcgagagagaggagtccaggaagacgggaaagtttttgtcccgagaaaaagaaactagagctaccctcaagtgggatggggaaaactacaggaggagcaggttcaggagaggaagggaaggcggtgaaaattgtctgataccttgtagacatccaggtggacaggcccagcaggcagtgctgcatggagatgtctagagtttgggggaggccaggctggatgtgccagtgagcaggataggaggctggaagggtcgccagggagtgagagctggggtctcttcaggcagggaggtgtgggtgacgggaagcatgtctgctgaactgaaagtctagatgttggtctgagttataaagacataaagaacgggactcttgctgtcataacatccacaagaggggggctacggaaatgagtggctgctcagcaggcccaggttctgcgctgccctcacctcctcctgcgtccactgtgtggccttgctaatgcacctgccccctctggaccttgattccttgactctggtgaatcatccttttggcatctcccatggagatgctggggcagcctcagagacttcaggtggcctagaaccatggaaaatggggagaaggggtggccaggggtacccgacgagctcagagcagagggtggggagaaagctgggcctgcagagcggctttcctggaggggttttagacagggcagccatggctcagagagaggaagaccccctccaacccacactgccctgcggcaggtcctgctgggatgactgagagggggcggctctggcaggagtcacacggtgacctcagctgtccctgaaaagtggctgagtcagcatctgggctgggctgggcttcagtgcccaggtgcgtcttctccatggccaggcaggagagggaaggccccttctgctgtctccccagccctggggccttttttctgctgctgatctttttgaggactcttttttcttttcaccatgaagggcagaagcatttcttgtaagcacctggttacaaactcagcacatgcaggccacagggggcccaggagccgtacagctggggaagctgaggcctggtgctggagagagacttgccctggtcacaagagttggaacagagctggggctccaacctgtgtccgccactttgccattcagaactctgaggaacttaggggaccagcggaggaagaggagccggcaaaggcagtgagaagttgcagcagctctgatgactggcttggcccaaggggcaggaggccacacctgccaggggcttcctatagatccagttctgtacagaatgtcctgtgtgctcctgtccacagctgtgccatcatcatgtccatctgagtcagagaggttgagcgtcttacctaaggtcacccagcaaatgaggggcagaagtgggtttgcatccaggtcagctccctcgagcgcctgctgtttccccagctgccccttgacaactgtggagaacaaaacgggaggccagcaggggtcaggtggggatggccgtaggaaggacagagttctgtgccggccggcctcccgcctcaggccacattctctctgggggacttgtcaactccactggtgtccctctgaacacccacagtccccatacctgcagctccacccctggcctttccctggggttctcctggaccgcattcccaatgtcctgattgagcccaggagttcaaagctgccgtgagctgttatcaccccactgcactccagcctgggtgacagagccagaccccatctgtagaaaacaaaacaaacaaaatcaaacaaacagctttatttgagtactgtttacactccataaaattcacctattttaagcattctctttaatgagttttaataaatttttgcagtgcacaacaaacaccgcaattcaaaagttccctctgtccatttgtagttgctcagcacatccggactgactcctgcatttgtccataggtcttctcttgccactctgtcccctgactagtgagtggcactatctggagttgaccctcgtggctgcacccaggatcccctcactgcatctccactagcctttttaaaaaacagctgtattgctgggcacagtggcttgtatctgtaatccctgctattcaggaggctgaggcaggagagtcacttgagcctaagagtttgagaccaacctggacaacatagtgagacccccctcatctcttaaaaatgaaaaaagaaaagaaaaaaattggccaggcgtggtggcgtgtgcctgtagtcccagctactcaggaggctgaggtgagaggactgattgagcccaggagttcagagctacagtgagctatgatcaccccactacactccagcctgggtgacagagtgagaccctgtctacagaaaacaaaacaaaacagataaaaacaaaacagataaaatcaaaacaagcaactttatggaagggctgtttacacgccataaaatccaactattttaagcattctctttgatgagttttaataaatttatgcaatgtgcagccaacaccacaattcaaaagctccctctgtccatttgtagttggtccccactcccacccctggccccaggcaaccactgatctgctttgtctctatagttttaccttttctaaaaaggaagtaaatggagacatataacatgtagtcttcacgtctagcttcattcactcagcataatgattttttttcttgttcttttttctttctttctttctttttttttttttttaagagacagggtctcactctgtcttccaggctggagtgcagtggcacgatcgtggttcactgcagcctcgacctcccaggctcaacgatcctctcacctcagcctcctgagtaactcggactacagatgcatcctaccatgcccagctaatttttgtggttttcgtagaggcatggtttcaccattttgcccaggctggtcttaaactcctaggctcaagcagtcttcctgcctcagcctcccaaagtattgggattacaggcgtcagccactgagcccagcagcatcatgtttttgatgttcatctatgttgttgcatgtatcagtgctttattcctttttagtgctgagtaatattccattttatggacattccacattttgcttatctgtttgctggtcaatgggcatttgaattatttccagtttggggctattatgaataatgctgctatgaacattcacgtacaagtcttcatggggacatatgttttcatttctcccatataacctcccttttccatcccaccagaccttgattcctgttgaggagccacacagctgtagggaaactgactccacccctcccgtgaggatagagctcaggccccagggtaagccaatgggcatagagctcatgacccaggctaggccaatcagtgtgttccatcctctaggcctgatgattggttcctggatgggcaagtgagataggccagtccaatcagagtgactcttaggactggcgctggaacagctgccctttttcatgccccttatagtatgtttgttaaatctggagcagacaccctgtgtgcattagcaaagccagctttaggatgtaattgacacatggaggaggacagggctaagaagcttgaaccctgattcaactgtgcctgaagtacaccacaaatccagacagttgcatggatcaatcaattcactttatcgttaaagccagcttgagatggtttcattgtttttgtttgtttgtttgtttgtttgtttgttttgagacggagtctcgctctgtcacccaggctggagtgcaatggtgcgatcttggctcactgcaacctccgcctcctgggttcaagcaattctcctgcctcagcctcccgagtcactgggattacaggtagctgccactatgcccagctaattattgtatttttagtagagacgaggtttcaccatgttggccatgctggtctcgaactcctgacctcaagtgatccactgcctcggcctcccaaagtgctgggattacaggggtgagccaccgcgcctggcccgttgttgtttttgtttgtatctcaggggtcagcaaactatggcctatgggcagcctgtttttgtaaaaaaaaaaaaaaaaaagttagaacacgccacttactaatgtattgtcaatggctgctttgcagtgccatatggcttgcaagcctgaaatattcaccatcagccttttaagaaaaagtttcaggcccctgttataaccaaaagcttagtattcagtatatcccccagtcatcaggacagaaatctgggaatcatccctgaatcctccctctacctcattccccacatcaaaccagccccaaattggattgattttttagtctacgtgtctcctgaatctgtctgctgtcttcaggccccagtatcctaggtgaaccattgtcagctctcgcctggatctcgccacccacctctagactaccccacaaagctgctgggtgatctttctcccacacacatttgacgaagcctccattgctcccagggtaaaggccagactccctggactggcactgcaggaccctcgtgagcgagcccccacctgcatttccagccccgtctctcccctctctcctctcgtcctcccccagagcacacagaccagcacctgacttgtgcagaagttcccaaacatggcgtgctctgtccctcttcccgccttttgtaccagctgttccttctgcctccaatgcccttcccactttgcccacctagtggacacctgtgtatcctctaaggcccagccaaagcctcgcctccttttttgttgtttctaaaatcaccccaacctgggtcagggctcccataagcccttggggctcaagaagtgttggtttgcaatacaatatttctgccttttgctgcaaagccactgtgaggaatccaaagaaggtttgaacaaggcagggaggaagagcatggctgtggactgtcagagctcggtgtgaacaaggggacatagaaggactggaactgcttgagtttccaaggcccaaagaccccaggcaggagcatctttaggaagtgcatagaaatgcctcctaagatgaacaaaatgaaccaacgatgaggtcggagaatggttccgagaaaagaaaagtagggcaggtgagagtgggccactgtggcaggccctgagagtgcggaatagaaacaaagggattacagggaaatgtcattaaagtgaagattttccacagactttggaagtcagcaagtgggacgggaggagaccagatggccggtgagggggctgcggatcccgtcggaaagtttaaggttttacaagactagccctttggagggcttagggaacatctgacttctaggttctcaactgaaaataaatttgggtaccagctggctgggtcctgagtgaaccttcccaagaagcaactgtggtggattcaggggagcactggacagggagtccgagccagctctgctgtcactggctgtatggttcttggctgccatgtcccggggtttagggctgtggcccatactcactgctaattctggaagtgaatccaggacacagaaaaccagaaaccagtcaaggcccgacctcccccatggggccacagtgaggcacgcatgagacagtggatatgaaaatgcaaactgcagtgcggtggccccacatcactgtccctcctctcactcctccagctgagtccatccccgtcctcgtggctccccagctgatgcatgaacctcactcttacgctactctgttgtggaacataatgtatggcacatctcttctcctgtcagaccctgagtacctgaggacagggacaagcatgttgggctcctgtccccaacatgtgttgcagtgcctggcccagagcagggattcggcaactatttcttgaaggactttgaattgtaaagaaatagttaacttggctgggcgcagtggctcacgcctataatcccagcactttgggagactgaggtgggcagatcacaaggtcaggagatggagcacatcctggctaacacggtgaaaccctgtctctactaaaaaaatacaaaaaattagccgggtgtggtggtggacgcctgtagtcccagctactcgggaggctgaggcaggagaatggcgtgaacccagggggcggagcttgcagtgagccgagatggtgccactgcactccagcctgggcaacagagtgagactccgtctcaaaaaaaataaaaaaaagaaaaagttaacttgaaggtgctggtcagcctcagtttataaaagcaggaaccaggtagatcatggtagaaatctttctgacaaattgacaaaatgttttgtgagtttttaaaaaatatgagcatgccagaaatgctcaagaagaagtggaactcaagcagttccagtccttccagtctgggattgagaatgctaaaagctacctggccctgagctatccagtagggtaaccatgagccacatgtggctattgaacttcaaattaaatttaaaaatcagttttgtattttatttaatttttattattattattttttgagacagagtctctgtcacccaggctggagtgcagtggcacgatctcggctcactgtaacctccgtctcccagattcaaggaattctcgtgcctcagcctcccaagtagctggaatttcaggcacatgccaccaccatgcctggctaatttttgtataaaaatcagtcttttaattgcactagtcacatttccaatgtgcagtagccacacgtggctcacggccaccctatgggagagtgcagattagagcatttccatcatggcacaaattcttttggacagcattcctccatgccttgaaaatccgtgcccatgtgttattttaagccctgatccttccgcaggggcttctgagacttagggagagatctggggctctggaatctgacccagagttcgaatccctgctcagccatttgcttgctgtgtagcctgaggcaaaggaacttccttctcctttctgaggctcggtgtcctcatttgtggcctacacaaagctgtgggttcaaggagaaagctaggtaaagggcttcccagttggtactgcgtgcaaggacctgctatgaggcacatagcggtgttcctagagctgtgagagactgcacaggctgttcctatcagaacattgccggaggggacgcctcccaggcccttgcagcttggagccactgcccaagcttctcaaaatgaggcaaggcatgctgggagttcatcgggcactgggggctgatctggagcagtggccagtgggtgtgactggcttggagcagttggtaggtgaggtcaaggctagaactggtaaggctgggaggaagggccagcccgctgaatcctgggtaggggcatgcgtcctctctgcataaaactccattgtctactagctgattaggggatcataatacgaatacaaggagtcatagcagctttatactccttgaacatttcctgtctaccagacactgtgctaagagatatactatgtgtatgcattagctctgccctcacagcaaccctttgtaataggtatgttattattcccattttgcagacagggaacactgaggccagttgtccaaggtcacacagctatgaggcggtagagctggtatctgaccccaggctgtttagctccacagagtcaatgctgggataaagtccagcccctgacccggtcctccaggccgtgtggagccagcctcagttgccctttccaccttcatctctgtcactcctcatcttctggtcaagttcctcagacatcccaggtgtctccctccaatgtctgtgcccttgttcacactcctggtcccctccagcctctgcagactcctgttcacctgccacgaccccgttctggtgtgtgagcatcccgaggctgggaatgggtttaagttgttttcatgtcataaagtcctgcacgtggcttggggcgtcagggccatggcgaattgtgggtggcggcttggtgggtgggtgatgagtagctggaagggtggggggagtagatgaagggtgaaccaaggggcgggtggacagactggtggaagagtgggtgggtggcatgtgctgcagtgccctcagtggggcggggcctgagcagagcatggggggctggacatggggagggatggcggcagggaggggtctagggtgatgcctacttttctagcttggggtcttgagtgaatcatggtgtcatcagggcagggtgggtttaggggagaaggggatgaggtccattttggacatgggggtgtgacgggccaagggttcaggaggccgctggggagatgagcctcaggttcagaggtgacctcgggctgcacagagagactcgggaggtcagtatgggtggtgattcgagtcgtgggggccaatggcgtcaccacctgggagctgggcatggggtgagaaggactcaggacagaggaacagccacatctcagagccagcaaaggagggggaagaattatagtcccccagatagaaaagccaggagtgtcagagcaacagaagagtcttgcggagaggagaaacaaggtgttgggggtgtaagaagcccccagggcatgagggaactccgtcagtgctattttaaaaaaactatttttccatttcagttcaactttacaaatatttattgagctaaaaggttctgtgtaaatccattttgtaaattaaatttttgtgcaacaaataccattttaactgggcctgaggtggcaaggtttgggagaccattcattattcgaggaaccctgagtcgaattcttttgaaaagctttgtttggtttgttttttgtgtcagcaaggattttggcttttcaggcttgcagagtgaggcgttcatttgttccacatgcgttttgaaaagatccttctggctgctgcagagaagatgggccagggaggcagccgggcacctagggaggaagctggtgcagtgtccgaacaagagatggtactggcccggacgggggcgactctgggggatcaaggggaggggatttgagggatgtataggaggttttttaaaaagataggacatggcctggcatggtggctcatgcctgtaatgccagcactttgggaggctgaggcaggtggagcacttgaggtcaggagttcgaaaccagcctggacaacatggtgaaacccccatctctaccaaaaatacaaaaaaattattagcggagcgtggtggtgcatgtctgtagtcccagctactcgggaggctgagacaggagaatcgcttgaacccgggaggcggaggttgcagtgagccaagattgcgccactgcactccagcgtggatgacactgcgagattctgtctcaaaaaaaaaaaaaaaaaaaaagataggacattgccagccatggtggctcacacctgtaatcccagcactttgggagactgaggcgggcagatcacctgaggtcaggagttcaagaccagcctggccaacgtgatgaaaccccatctctagaaaaaatacaaaaattagctacttgggaggctgaggcacaagaattgcttgaaactggggggcagaggttgcagtgagccgagatcacaccactgcactccagcctgggcaacagagtgagactctgtctcagaaaaagaaaaaagaaaaaaagataggacatagtcttgggctttacttctgggtgagtgaaagaggagaaggaagaagaatagaagcctcctggcttcttggtcgcctgagggtgaccaggttagatgatactgggatgagggcatggtctccagggaaggtcacagactgggccctgtacacatggagtacacagtgtctgtccacagatggccagcagagctgctgtaggaatttggagctcagaggtgtgagctgggctggaaagagaaatgtcacatctgcgacaaggaaggagggaaaacccagagctcatgacagttggtcaaggaatatctccagtattgaaaatatttgttcaatgaagtattcacggagcacctccatgtgccaggtacagcgtgtggcaatgaaacagacagaactctctacccttcggggctgacactttagtgagaggagcaggcaatgatcaggataaattatgcaattacgtggcctgttgtataatgatatgggctgagaaaaacaggaaagcaggcagggacaggctcagggaatgtgctgtggagggctggggagtgtagcagacacacaggtcacacttgctgaattcatttgagcctcacaaccaccatatgaagaaggctctataactacccccatcttagagatgagcagctgagttgcagagaagatatttgcccaaggtcatgcagccacgtaactggcagagcctggatttttacttggagttcatacttttgagtcctcctgctagggtaaaactccctctcaatgacaagatcaggtctcagcaaagattctgaaagaagtgagggggtaaggttcacagacatctgaacacaatcaacattccaggcagagcaagagcacgtgcaaaggccctgagctaggcacgtgcctggtatatttgaggaacagcccaaaggccagcatagctagggcaaaaggagcaggtgggggagggaaccagaggtggtgcagggctgcctgtggcgtctgcagggctgttagcttttacttgaggtgcagtgaggccatggggagtgtggagctgaatacaaggagtcatagcagctttatactccttgagcatttcctctggcttctgtgctgggagcaaggtcagaagcaggacaccagagagggcatgaataatccaggcacgaggtgacagtggctcggtccacagcggtggcagcagggtggggaaaggaggaccggtggcactgctgatggcttgcgtgtgagaggggagggtgggagagacctcaagtttggcttgggcctgagtggctggaagggcaggattccattgactgagatgggggcagctgtggaaggagccacttcataaagaactttccatgtccatttccctctgaatccctggctaccctgaggtaggtattgaaacttgagcagttccatgatttgcctgggattgcttggctggaaggtaatagagccagggccagaagccgtatgtgcatcctagggtttggaattttgtctcatttattcaatcaacaaacatttctggagcacctcctgtgtgccaggctgatggaggaggctgtgtcagccaatgatcgtggcaatggttacctcacatcagcatgagcagtggtgaggagaagccgagggagctctaggagccagtaacgggcaggagggaagggtgctgcagggccagggagggcttcctggaggaggagaatatgacatacaaggaccacaaaggaccacaggttcccagaggataactgcctattgggaagttgcagaatctttttgttttgttttgttttgttttgtttaagtgttaataattgagatatagaagctgagcatggtggtacacacctgtagtcccagctattcaggaggccaaagtgggaggaccctttaaggccaggagttcaagagcagcctgggcaacataatgagatccccatctctacaaaagttaaaaaactaacttggtgtggtggctgatgcctgtagtcccaactacttttgaggctgaggcaggaggatcccttgaacccaagaatttgaggccaggcctgggcaacatagcaagactccatctctaaagaaaagaaaaagaattgagatataattcacataccatacaactcacccattaaagtgtatagttaatggcttttagtatatttacagggttgtgtatctgttaccacaatccatttttgagcattttcattacctccaaaaagaaaccccacaccccttagctgtcaccatctctcagtccctgtccccacactgggaagcctgaggcagcccagatatactttccgtctgtacagtggcacctgttctggatatttcattgaaatggagtcatgccatgtgctgtcttctgtgtctggcctcttccacttagcatcacatttcaaagttcatccatgttggaagctgcagaatcttcaacagcatcacagatggcccggacccaagagactgtataatggtgcttcccgaccattataaagaagtggggccaagctcagtagctcatgtctgtaatcccagaactttgagaggctgaggtggatggatcacttgaggccaggagttcgagactagcctgggcaatatagcgacatttcatctctgcaaaaaatacaaaaattagtcaggtgtggtggtgcatgcctgtagtcccagctactcaggaggctgaggcaggagggtcgcttgagcccagaaggtcaaggctacagtgagctatgattgcaccactgcactctagtctgggcaacaaagtaacactctgtctcaaaaaataaaaaagaagaagaagaagggggaatcaaggaggagacttgccgttctgtcagcaaggaagaggtggggaatttgaggaggcctcgggcccctaggccagggccctgcggcaccctgccgtgctgggcacaggccacctcccttggttgccacttcttttccttcagctttgggctctgggtgaatttggctaaaagtgacaactcggtcaggaacgcatcttctcaaacaccggtctttcccgccctggcaattttcacaccttatggtgaatcttgaaatcttttatgcatcttcgagaatttgtgtctactgactcagaatgttttggggtttgtattttctttttctgctccttaacacttttattcaggtggctatgcctgtttttcttggtttggtgatgttgtccctgggggaggctgcatcgtcctggagtcaggtgcctgggttggaggccctgccctgcctcttcctgggtgtgtggttgtcgaagctctccgtgccttggatgcttcctttggaaaatagagatgacattgtaaggctgtggcaggaaggaaatgaggtaaagcctgttacaggtttggcactgagtagattctggaggtttggttcttgatcagatgctaaggagagatggtgaggcctttcagggccctgagatagcaaggggagaaaggtgagcctccccgaccagcgactgtccctttctccttattcctcccatcccagagccccctagacctggacctctcctctcagggctcagacgtggaaagcctgagttcaaatcccgacctaccactcgggttctgtgtccccacaccagctaggcttcttctgtgtctcagtttcttgacctgtaaaattggaggggagagggtggagggtgaggggagggtgttccactgaggcctccagggcagccaaaaggcttctgggaggggtgtggaatagaggggcctttttcttctccctagaggactggttcctgctgattcgtgggttttttgtttttggttttggtttttttgagatggagtcttgctctgtcgcccaggctggagtgcagtgacaccatctcggctcactgcaacctctgcctcctgggttcaagcagctaattttgtatttttagtagagacggggttttaccatgttggccaggctggtctcaaactcctgacctgaagtgatccacccacctcagcctcccaaagttctgggattacaggcgtgagccaccgcacccagcctggttcctgctgatttaaagatccaggcaggagcagtgacacctgttcaggggaagtgggtggagagggacacctggcttccctccgctctcacacgagagtgccacatggaggtggtgatgcagtgaagggcctcttagaagggcctttattgggcttatttcacctgcactgtcttctcagtcctcacagtagccttcagagaaggcactcttgttcccatttggctggtggggaaactgaggctcagaaaggggaagctgcctccctggtgtcaccccgcatgtgagaggctgagctgggatttgaactcaggactgcatgactcctacccctttcccaacttctcccatccggggaaaaggaggaagaagcaagacagggaaggatttgagactttggaacccagcttcccgactgctgtggggattctgtgggtggtgggaaaggcactgtaaatatgcatgacatgcaaatttgcctctaaaaaaacaatgtgggtgctcacatgagccgggatgccagggtgctctggaaaatgtagtgttgtgcaaacacttgggtttctatgaccactgctccatgtcgtctccttccctcgtgtccccagggccagtctaagggtctcaggtggagggcttacctccagcacctcctaatcaccattcctccccattcctgcaggcacccgtgcctcccctctgccaggaaccttggggccttgtgtgtgaccaggacctggtggcccccgggcggtggcagagcccctgtcccaagctgcttcctgccggcacctctgatcaagtgcctagagggatgtgtgtgccagccctcggtccagtgcccgctcctgagctgactcctgctgggccccgacagcttgccgtgtttcctgtgcctgtagctccctggttggtaagtaactgcgtccgcaggctttgtctcctcaccagccccccatgcttggcacagttgggaaatgcccagcctcacttccactggcacccacatgctggcagagggacctcagtcagagtttgtatatgtctgggcaccatttatagttcaatggcctgtcttagccagtcctcccaacaaccaggaggtgcgtgtggtgatcacgcccattttccagaggagtcagcctcagagaggggaagccacctgcttggggtgcacagcaagcccagctctgtccacctcaaaggccagctcttgccacacccaagcaggcggggacaggttgtgcacataggctcaggacaggaagggagccatgagctgtgctggaggccatagaacctctggggcccccagggcggcttgaggggaggccatcagaattcttgaatcttggggggccctacattcctgcccctctggcctgttctccccatgctcctccagctcccactttgccatcaggatgaggtgctgggcctgccccgtctccaaccgtctgtctgggggtgcaaccacagtgccaccacttcaccatgctgcttgcatcttttcttcaccttccgcctcccaaggctctgctggcataacaatctagttcacagatgaggaaacagaggctcaaccaggtcaagaggcctacgtgcaggctcacccagccaccacgaagcactacatggggccactggggtaaaatctgcctccttctctggccttagctctgcaaggacaaagaacaaccacttcattcccttctggccaactagcagctggccccgtgcctggcatacagtgggtacccagtaaatagctgtggaaggaaggaaagggggagagaagaagggaaacctctcttacctccctccacccagacaccagcaggacctgagcgcctcctggccttttggccagtgccagtccctgctgccccagatggcttgcggtgagcccatgccctcagcaaggtggccagcccctctggtcccaattctctcatctgctagagcctgcccagcttccctgatgggatggttatgagaagggaaaagattcgtaaatatgtataatatgcaaatgtaatgggatcttttgtttctttaacccttgaagttcactgtagataacgtatgtagaagtgcttctgtgagaacaaggagctgcccgctggggtggcgccagccttattatgactaaccatgaaaagggccccattaattagctgccccacaacctggctctcccgacccagctcctagtctgttgttgcggctgcaaatagccgttgcttttggctgagaagctggtgcaggacaggtgataaggatggcttggtctgagagctgtgtctgtgggatttaatcatttgcaaacacaccttattgtgctcaaggaatgcaagggcctctccagggactaaatgtgtaatgagggccagctgaataacagcaagcatttcttgagcaattactatgtgtttggcatcgcactaaatgctttgcatttttcgttatttcaattaaattcccccataaccctgtggaaggtgaagggggagactgaggcagggacttaggggtgagggctcatctgttaacagccagcatttcctgaaaattactgccatccagtgcccacctccaccctccgggccaggctctgagaacgcagcagagcagacagcccctggcgtgtgtggcccagtgacggagaacgggattccttggcacgagctgggtgagcagccgtcagcatcgcgtggaaagatggaggcccgggcggcagcgagggaggtgttactgctgctattttgctaacaagctggttatttaaagaacagccgaagccggagctagaaaatgggatgaggtgtctccagggcagaggcagccaggagtgctgggtcctgagacccagagacctggttgaatcacagcagagtggccacacagtcatttattttttttaatcaacttattaacatagtaatggctgccgggcatggtggctcaggcctgtaatcccagcactttgggaggccgaggcaggcggatcatctgaggtcaggagttcgagaccaccctggccaacatggtgaaaccctgtctccactaaaaatacaaaaattagccaggtgtggtggcaggcgcttgtaatctcagctacttgggaggctgagacaggggaattgcttgagcccaggagacagaggttgcagtagccactgcactccagcctggccaatggagccagactctgtctcaaaaaataataaaaacaatagtaatggcaccataaaggctggacaaggattgccttggtggagaaaagaacattgggaagggaacctcagggggtttctgaggggccagcagtgacctgggtggtggttacatgactatttccttttgatattttactgcagtaaacatttttgttttgtgcactttactctttctattacatatcacagtaaaacggctaaaaaacaattgtaaaaataatagctaatgtttattgagcacttactaacaggctgtttgctaagcattttttatctccttgaatcctcctggattcttttattctgcccattttacagaggaggaaagtgaggcttggagaggtaaaactacttgtcatgctgccaaagagtggaggaggtgagatgagaaaccagacagactgacttaagcctcatgtgcaaggatcggggtccaggaagttccccgcaaagggccagggactcctccattttttcctcagacatgtctgtgcctcttctatttttaaggcttgggaggccaggcaggtgtgtgcagtcataggcagcagatgaggagcctgggggtctccaaggggacagagcagagcatttagctgtttaacaagtatcaaagagctgggtgcaatggctcatacctgtaatcccagcactttgggaggctgaggcaggaagatggtttgagcccaggagttcatgatcagcctgggcaatatagtgaaacctcatctctccaaaaaaaaaaaaaatttaaatagctgagtgtggtggctacttgggaggctgaagtgggaggatcacttgagcccaggaggcagaggttatggtgagctgagattgcaccactacactctagcctgggtgacagagtgagaccctgtctcaaaaaaaaaagtattaaaggataggagtgggacgttcctagggacaggcctggggagaaggccaaggcatactcaggtctcatttaaagtaataaaagaggtgggagaatggcttgaggccaagagttcaagaccagcctgggcatcatagcaagacccccttctccaaaaaaattaaaaaaaaattagccaggcatggtgatatgtgccggtagtcccagctactcaggaggctgaggtgggaggatcacttgagcccaaaagtttgaggctgcaatgaagtatgatcatgccactgtaccttaacctgggcaacagagcaagaccttgtctctaaataaataaataacattaaaaaatttttaaaggtaaaaaacgccatccaggtgagacagggtcagacccacctgtgaactcactggatggggggccaaactgcaattttctgaggacctattttgtgctaagcacatttgttcccttctttaatcttcagaacaaccttgtgggattagcagtattggccccattttacaaatgagaggactgagacctaagtccacacagacagtgggtagtggagctgctctgccagactccagtgccttgtatcctgtgcgtgcagaaagccttgcttggtgctggggtccctggcagggcaggcatctgggcatagatgctccaagcagcacatggctggaagtgagttccaaggcagctctgtggggccctgaactgacactagggacatgtcatggagcggggtagtctgctatgctgacggagcatctcttcattcatgcgttccaaggacatctcttgagtctagtccctgctagtccacacccttcctggagcacacaggcttggggagggacagatattatacagtcacccaaagacatacacagaatgaggagagactccattggtgcagtgagggaaattaacgtggtgacatcatgaagatgaaccggtaggagacctgtgtgacatggcactgtccaagatggccctctctaaggagatggcacttgagctgagacccgaaaggatgacgtgcatccagccgtgctggacagtgctcatgtaacatcgttgctgttagcaggacaactggggacaacccatttgtccatcaccacgggaccagttaaagccattttactgcagccacaccgtggcgcctgctacagctgttagaaacggggccatggagctaaatttattattgcataaagaacttcatagtgtgtcgtagaggtttttgtttttttttttaaaaagaggttataaaacagcatgggtagcattatatcatttctgtaagaattatatgtgtttctggaaactgcacagtgctcttcctgggaagtgggggcatgggtgatctttgcttcttctttctacttttctggatttggagtctttcctgagttttaggacttgtggggaggaacagaggattttagggttcccaccatcttgcctagggtacttcttctctcctgctacccacctcaatgggataaggcatgggctggggaatcagcagatctgggtcatccctttgactgtgtgaccttgggcaagtcactggccttctctgaggctgagtttcctcttctgcaaaacagataagaatagcgtccgagggtaggtgtgggcttaagtgagtagaaacatgtggagggctagggcagtaccaggcttgcatccctgacggtgctgctgctgttatgactgtgactgctaaaggtggcacctaccgtgtgtcggcttgtcctgccagggctccccaggcttacctctccctccgtcactgggagtcagacccaggtaggagacaaggcccagggtgggctttgtcacattgtcagcttggctgggcacaaggccagctggacctcaggtcagcaccaacccacaccccgcctctctccccaccacctccctccccatcacctccctcacatctgccagtgagcatccttgctagataagctgtgatggggacaccctggcccaggatttgctttttttttttttttcacaactagtatacctgcccaggaaaacagatactactttacagccactaagagaatcttaaatctcaggcagaacaacgtacactcgtgaagtcaaactctctgaatcatggaatcttagtcataaataatccggcaactgcaaacatatgcattttgcaagtaagttcactgcacctttcttgattacagtgataaattagaaacgacccaattctctgtttgtgagagttggttaaataacttacatccggccaggcaatgccattttccgcagctatagaaacagtgctgtaaatctctatttgttgacatggaaacttgtccatggcgcattgttggggaaaaacaggaggttaaaaattgatgtatgttgtgtgacatccggatttggaatctttcctgagtgttaggatttgcagggaggaacaggatatctacttaggtatctactgatttttttttcacttttgttatgaaaaatatatataaacatatgcgtgctcctgcctagggagatgctcagaagagtagtcattaaactgttgatagtggcttcctctggatggtgagatataggtgagctctattttgatttttgtttctatcattcagagttttttcaagtaaggtgatggaaaacccaccccaaactagtttaaacaaaaaatagattcgattgacttgtaactgtaaagttcagaggtctgatggcttcaggctcagctggatccaggacctcagggccaccaggacttgatttctgtttctcaactctgggttgtttccatgttctcattaagctctcatgtacaggtaataagatttctgtccaaagaaataagcaagaattcttccctgattgctcaaacacaagtcccagaactaagtcttggccttgatttgtcaaatttgtgggatgtgcccacccctcaatcaattgctgttgctaaggagaatttggtgctctgattggcagcctgggcctgtgtaccatccaccaccagctgggggtggggtcaataccactggaacctcaagagtggagagtggggaaaagtggcttccccagaagtagatgtaggctatgacctaaagtagaccaaatggtagccaaacccagcaacccccacctcctgtaattatctgaattgcccaagatgcatggttttcaaaatcagaaaaaaaacaatgcaactattgaaaggagtcctggccaggtgcggtggctcatgcccgtaatcccagcactttgggaggccaaggcaggcagatcacctgaggtcagacaggagttcaagaccagcctggccaacatggggaaaccctgtctctactaaaaatacaaaaattagcccagtgtggtggccagcgcctgtaatcccagccactcgggtgactaaggtggaagaatcgcttgaatgctggaggcagaggttgcagtgaaccgagatcgtgccactgcactccagcctgggtgacagtgagactgtctcaaaaaaaaaaaaaaaaagaaaaagaaaataaaggagtcttgaacccagatcttacggtcagaagctcactgaggcagccttcgactttcctggagtcagaacattggaatttctgaagtaccgatttcactagggagacatcaaccctctctgtcctgccagggagctgtcctggccctccaaatgactgcagtctttggaggagaggggagcacatggatgatttgtctggaatgtgagaggtgctaaggtggatgtgcatataggggctgtgggaatgaaaaggccagcctggggacaaggaagaggcttcttggaggaggtgatgcctaaactgagtagccaaccagagtgctggaagaatgttgtaggcaggaaaaacaatgtgtcaaagtcccagagcatgtggtgggagtgcaactataggatgagaggaggcaggcccggaccacaggggccttgaatgccagggtaagaacttggacttgatcctgaaggcagtggggagcctttgggggatattgtgggatgaaggaagtgtcagtgagctcactctgccttgtgctggaagcatagcctggaggagttagatcaaggccccacatggggaacgagaaaaaggacccaatgcccctcaagggagccttagatatctaatggtctaaattccttcccaccctgagtcagaattcctgtcctgagatgcccagccactgcttgcatacctccagagat
